United States Patent 11,293,064 (HUMAN MIRNAS FOR USE IN DIAGNOSIS, PROGNOSIS, AND THERAPY OF HUMAN CONDITIONS AND DISEASES) - sequence listing, part 2

SEQ ID NO: 24206 - DNA, 65 bp, Homo sapiens
acagcgagaggcagctctggggctgtgtcctgactccagctaacccagggtaccctctcgttgca

SEQ ID NO: 24207 - DNA, 65 bp, Homo sapiens; identical to SEQ ID NO: 24206

SEQ ID NO: 24208 - DNA, 56 bp, Homo sapiens
tcctgaggctcgtggtttcccagctgagagaggcgaccgtgagcctcaggaacacc

SEQ ID NO: 24209 - DNA, 74 bp, Homo sapiens
ggggtgcagggggcgctcggctgctgcacctgttagtgctgggcccaggttgagaggcgacctccagcccccac

SEQ ID NO: 24210 - DNA, 65 bp, Homo sapiens
cctggcccagatctgataagctggctcctttgcatgggggtgacttgcaaggcccaggtgaggag

SEQ ID NO: 24211 - DNA, 61 bp, Homo sapiens
gcagccctgcccggctgggcccgcctgccagaccagcccggcccagccgcgacgggctcga

SEQ ID NO: 24212 - DNA, 61 bp, Homo sapiens; identical to SEQ ID NO: 24211

SEQ ID NO: 24213 - DNA, 66 bp, Homo sapiens
gaggcggaggaggaggaggaggaggaagtccccaggagccagctctcctcctcctcaacctcatcc

SEQ ID NO: 24214 - DNA, 68 bp, Homo sapiens
tcccaaagtgctgggattacaggcggcgtgagccaccgtgcctggcctatcccggcacttttaggaga

SEQ ID NO: 24215 - DNA, 67 bp, Homo sapiens
cgtggagtggaagcccagggttgcagccctctagtttccttgctgaccccaggaatcccctcccagg

SEQ ID NO: 24216 - DNA, 83 bp, Homo sapiens
agtgggcgcattgtgggggcgggtgcaggcgggcagctcggggagccccagcctgtgacagccgtcctcactgaccccgcagt

SEQ ID NO: 24217 - DNA, 54 bp, Homo sapiens
gcggcggcagggcgcggacggccatatttgccggcgcggcccgagccgccgaca

SEQ ID NO: 24218 - DNA, 68 bp, Homo sapiens
tggcggcagctggagcggcggccgcggtggcagaaccgggggcggccgctgcagtctggagccccata

SEQ ID NO: 24219 - DNA, 69 bp, Homo sapiens
ctagccctgaactatctcattttgcccttgcaaaaataagattttagaatgaggtattcagggctgaga

SEQ ID NO: 24220 - DNA, 60 bp, Homo sapiens
aagattccaggggctcaaaaacgcaaaggtttgcactttgagagccccttggaatgttga

SEQ ID NO: 24221 - DNA, 68 bp, Homo sapiens
cacgggggctttgctgggtcagccctctctccattgaggtgtgggcccccctgccaggtcctagtgga

SEQ ID NO: 24222 - DNA, 75 bp, Homo sapiens
ttggcggggcccctgcactcccgagttggcgctctcggggggtggcctgctggggagcaaggcgccccgccgaca

SEQ ID NO: 24223 - DNA, 66 bp, Homo sapiens
cgtcgcagccgggatttgggtcgcagttcttgtttgtggatcgctgtgatcgtcacttggtgagta

SEQ ID NO: 24224 - DNA, 113 bp, Homo sapiens
gggaggcatggaaatttctctggtttcaatgggtacgattattgtaagcaggatccattcaataatcggacccatttaaaccggagattttaaaagacaggaatagaatccca

SEQ ID NO: 24225 - DNA, 66 bp, Homo sapiens
ccgcggggcaggcggggagcaaggcctaggctctgccagggcagcagctgcccgagtcccggggcg

SEQ ID NO: 24226 - DNA, 71 bp, Homo sapiens
ccccggcgcggctggagggggcctggctgagcgccccgcgtccccgggtcccgcgtccccgccccccggcc

SEQ ID NO: 24227 - DNA, 57 bp, Homo sapiens
cacgccactgtgccttgcttaaaaataatctttttaggctggatgcagtggctcacg

SEQ ID NO: 24228 - DNA, 51 bp, Homo sapiens
cgcccgcgcgctcaccactcccaggctgaggtcctcggcgcgcggcgcggg

SEQ ID NO: 24229 - DNA, 85 bp, Homo sapiens
gtctcaggctctgaggcccgggcgccgcggctcttttgtttctccgttggggccgagcccgggccctagttggagccggagtcgg

SEQ ID NO: 24230 - DNA, 59 bp, Homo sapiens
gctgagggaagggctggcaggccgtgttttggtggcctcctccgtccgcctctcagagc

SEQ ID NO: 24231 - DNA, 51 bp, Homo sapiens
gcggggaggggctccggggccggcgccggtcctgacgcttctctcccgcag

SEQ ID NO: 24232 - DNA, 81 bp, Homo sapiens
gcgcggtggctgcggggcgggcaggacaggagccggcacagacaccgagcgccgcccgcccgcgccttccccgccgccccc

SEQ ID NO: 24233 - DNA, 51 bp, Homo sapiens
ggccgccttgctgtggggcggggatgcgcgcgcgggcatcttggcggcctc

SEQ ID NO: 24234 - DNA, 74 bp, Homo sapiens
gcgaggccgcctccagggaggacacgatctgcctcctgcagaacgagaagatcatcttggaggcggctttgcag

SEQ ID NO: 24235 - DNA, 89 bp, Homo sapiens
tcgccgaccaggtagggcaccacctccaggaggccctcgaagcaggcggcgcggaggggcgtggagttggtgcgcgtggtgcggttcac

SEQ ID NO: 24236 - DNA, 65 bp, Homo sapiens
taggtctttaacacaacttgaccaaattttgtatgtggtgtgaaatagttaatcttgttgaccta

SEQ ID NO: 24237 - DNA, 54 bp, Homo sapiens
cagggccgtcgcagccgctgtcgacaccggcgtcgcggcctcggcgggtctggc

SEQ ID NO: 24238 - DNA, 54 bp, Homo sapiens
tagcgggctgggtagcgggacagcagcgcacgctgcccgcttccgctcgctccc

SEQ ID NO: 24239 - DNA, 62 bp, Homo sapiens
gagcagccctgacccgtgggggcgcgcggcctcgcggggatcccgcgggcgggcgggcggcc

SEQ ID NO: 24240 - DNA, 64 bp, Homo sapiens
caggccggccgagcggctgggctcagggggtactcctacgtgcgcagccgccacccggcctggc

SEQ ID NO: 24241 - DNA, 71 bp, Homo sapiens
ggcggacagcgatgctcagctggctgcggccgagtcatcgcctagcgctggcagggccgctgaccgaccga

SEQ ID NO: 24242 - DNA, 58 bp, Homo sapiens
tgcctgtttggggaagctggtcgtttccactctagctcagcctcccagaacagggaag

SEQ ID NO: 24243 - DNA, 58 bp, Homo sapiens; identical to SEQ ID NO: 24242

SEQ ID NO: 24244 - DNA, 52 bp, Homo sapiens
ggccggcgcgcacggaatggccgctgcgcgtcttctccgcctgcgccgccgc

SEQ ID NO: 24245 - DNA, 71 bp, Homo sapiens
tctacctgatataaccccaactgacttttaaaaagttgcaaaaatttagttggggttatatgaggtagaga

SEQ ID NO: 24246 - DNA, 88 bp, Homo sapiens
cgcggcggggcgcgggcataaaggggcgcggcgcggggccccggagcctggctcccgcgcagcatgcccgccagcgccccgccgcgcc

SEQ ID NO: 24247 - DNA, 57 bp, Homo sapiens
cgcgcgcgtccggcacggagcccacacccaccgggaggcgcggcgggagggcgctcg

SEQ ID NO: 24248 - DNA, 58 bp, Homo sapiens
aggatttaagaaaatatcaaaaatacatataagtttttgatatttacttaaatcctga

SEQ ID NO: 24249 - DNA, 74 bp, Homo sapiens
tcccggaagctgcagcagctggtaacaaagagcctgccgggccgcctgctgccggggccgaggtatccaggagt

SEQ ID NO: 24250 - DNA, 63 bp, Homo sapiens
accatcctccagggtgtagcagtttgcatacctaaagatgcttctaccttctggaagatgcct

SEQ ID NO: 24251 - DNA, 66 bp, Homo sapiens
gtgcaaatgtaatcatggtttttgccattgaaagtaatggcaaaagccacgattacatttgcacca

SEQ ID NO: 24252 - DNA, 55 bp, Homo sapiens
aggtcgggccgcaggggcggggaggggtggcctgccccagtggtacctgacagca

SEQ ID NO: 24253 - DNA, 58 bp, Homo sapiens
cgtgccccctggctctggtgcccacgcagccagcaagcactgagctggggggcagggt

SEQ ID NO: 24254 - DNA, 79 bp, Homo sapiens
atggggtacagattgtccactcccacagtgtgttctgatgggattggcatccatcgcaatccagtctgatgcctgtgca

SEQ ID NO: 24255 - DNA, 64 bp, Homo sapiens
cactgggcaccaagtctgtgtcttggtgtcattgctattcacacagacattgtgtccaggttcc

SEQ ID NO: 24256 - DNA, 58 bp, Homo sapiens
cacacacaaagtctatgaatactgaggatagaaggtgttcatagatttcgtgtgtgtg

SEQ ID NO: 24257 - DNA, 77 bp, Homo sapiens
gccacttaccaacccgcctgggacaacgccgcgccggccacctgggccatggtagctgcttaggccgggggtggtgg

SEQ ID NO: 24258 - DNA, 58 bp, Homo sapiens
gaggagggtagtgagagccagcccctcttccacccctggctcttaggacccgcgtcgc

SEQ ID NO: 24259 - DNA, 61 bp, Homo sapiens
caagccggtgctgggcgccgcgaatccggcccgcgacgcggcgctcttccccggcgaggag

SEQ ID NO: 24260 - DNA, 70 bp, Homo sapiens
tttcagtttgtaccattgtttgaagtactcagttggttgaatactccaaataatggttcaaattcaaacc

SEQ ID NO: 24261 - DNA, 78 bp, Homo sapiens
ctcgcggtggttccgggctggtcccgggtctcgggcatcccctcccggcgccactggccggtgccctacaagtgagtg

SEQ ID NO: 24262 - DNA, 82 bp, Homo sapiens
cctgcccctccgccgttacctgctgccgggggcggcttcccccacacaccaccccgtgctccggggacggcggcggctgcag

SEQ ID NO: 24263 - DNA, 60 bp, Homo sapiens
tgaggtagtagttgtcctacatactaaagaatatttagcagcatccccggcttctaccca

SEQ ID NO: 24264 - DNA, 57 bp, Homo sapiens
accggtaagtttgatattcatgctagtgaacatggcatgaacatcaaacttacctaa

SEQ ID NO: 24265 - DNA, 53 bp, Homo sapiens
tgtcccagtttccacgtatcacaagaatgacacaggcatcagggatatggtgc

SEQ ID NO: 24266 - DNA, 57 bp, Homo sapiens
tcccggatctccgtgtcccgctctaccagcttcctgggcggcatggggtctcggggc

SEQ ID NO: 24267 - DNA, 82 bp, Homo sapiens
gcagtcctctgttagttttgcatagttgcactacaagaagaatgtagttgtgcaaatctatgcaaaactgatggtggcctgc

SEQ ID NO: 24268 - DNA, 61 bp, Homo sapiens
gattggaggggtctgatttgttgaggagaggggaataaacaaatcagactcctccaatcct

SEQ ID NO: 24269 - DNA, 67 bp, Homo sapiens
ccccgcctcccccagctgccgacgtggggcgggcagccgccggcggctgggagccgaggcgtcggtg

SEQ ID NO: 24270 - DNA, 58 bp, Homo sapiens
tgctgacatctatctcctggacgatcctctcagtgcagtagatgcggaagttagcaga

SEQ ID NO: 24271 - DNA, 58 bp, Homo sapiens; identical to SEQ ID NO: 24270

SEQ ID NO: 24272 - DNA, 58 bp, Homo sapiens
ttgtatccagagactttgctgaagttgcttatcagctaaaggatattttgggttcaga

SEQ ID NO: 24273 - DNA, 77 bp, Homo sapiens
ctggtaacactggggttctgagacagacagtgttagctccagaagcattgcctgtcttagaacccctatgttaccag

SEQ ID NO: 24274 - DNA, 54 bp, Homo sapiens
tcgccgttggcagcagcagcagcaacaccagcagcagcagcagccccggcggcg

SEQ ID NO: 24275 - DNA, 82 bp, Homo sapiens
ttattgcaaaagtaactgtggtttttgccattaaaagtaattaaaagtaatggcaaaaaccgcagttacttttgcaacaacc

SEQ ID NO: 24276 - DNA, 61 bp, Homo sapiens
aggactgctggaggaccacaaagaaatgagcctactcctctggggccctgggcagacctcc

SEQ ID NO: 24277 - DNA, 66 bp, Homo sapiens
gcgggagcgcgcggcccgggagtgtggctgcagtgcgccgggacaccagggctccgcgctccgcac

SEQ ID NO: 24278 - DNA, 57 bp, Homo sapiens
ctgatgggttggtattggcttctggtgggaagcttccattgctttccatgtagacct

SEQ ID NO: 24279 - DNA, 79 bp, Homo sapiens
gtcctctaggccagcgagccccgcgctctccggtgacggaccatgtcggcggcgggagcgggcgcgggcgtagaggcgg

SEQ ID NO: 24280 - DNA, 75 bp, Homo sapiens
gagcggagggggaagggcggcgaggcggggcgatgggaacagcctgcccctctccccctctccccctctcccacc

SEQ ID NO: 24281 - DNA, 67 bp, Homo sapiens
ccgcgcgtcctgacgcctcctcccagggctgcgccgacactgggcggggagagagaaggggcggggc

SEQ ID NO: 24282 - DNA, 56 bp, Homo sapiens
cccgatgcggaggcgggtccggctgtcgcagggagggcccaaggcggctccgggtt

SEQ ID NO: 24283 - DNA, 58 bp, Homo sapiens
gacagaccttagaggagccaggtcctgggatgagacctcctggtcccccaagcacctg

SEQ ID NO: 24284 - DNA, 51 bp, Homo sapiens
tggcccggcgtcgcctctgcccgtcggggtcggggtcggggtcgggcccca

SEQ ID NO: 24285 - DNA, 84 bp, Homo sapiens
gccccgcgctccgcaccgcgccctctccgcgtccccgcccgcgcggccggaccgggcagccaggtgcgggtgggcaggggatgc

SEQ ID NO: 24286 - DNA, 76 bp, Homo sapiens
cagcgcctccctcccgccgctgcaggggggtgccccaccacccacctgggcacagccccggggtcccggcgcaacg

SEQ ID NO: 24287 - DNA, 65 bp, Homo sapiens
ctgagacttggggctctgaggcaggctcgttcctgctggcactgcccggggccctccctccagag

SEQ ID NO: 24288 - DNA, 65 bp, Homo sapiens
ctcctcctgctcggcctgagctgcccgggctcggcgcgcgcttggggcgaggctcggcgggcgcg

SEQ ID NO: 24289 - DNA, 57 bp, Homo sapiens
tgggcaggagatgccgtggaccccgcccttcggggaggggcccggcggatgcctcct

SEQ ID NO: 24290 - DNA, 53 bp, Homo sapiens
ttctccactagggcaccagacagggcacatgtctggtgccctggtggagatgg

SEQ ID NO: 24291 - DNA, 58 bp, Homo sapiens
cagcctttatccttactgtctccaggcccgggagagtctgtggggaccagaggctggt

SEQ ID NO: 24292 - DNA, 66 bp, Homo sapiens
gtgcaaaagtaattgttatttttgccatgacttttaatggcaaaaacagcacttacttttgcacca

SEQ ID NO: 24293 - DNA, 66 bp, Homo sapiens
cggaaggggaagggtgggatgcaaaggggctgtctactacccgtgtcctaccttcctctctccagc

SEQ ID NO: 24294 - DNA, 60 bp, Homo sapiens
tgcgcgggtgggggggcggggcaggctggccgcgtgcgtgccgactcctgcccgggcgct

SEQ ID NO: 24295 - DNA, 89 bp, Homo sapiens
agctccgggccctgggcctggttcgggagcccccggcagccaagaggaggaggaggagccgggactggtcgagggtgacccgggggacg

SEQ ID NO: 24296 - DNA, 73 bp, Homo sapiens
tcctcctctgtctccccccaggggccgtggcctgggcctgatcatggctctaggggcgcttggaggactgagc

SEQ ID NO: 24297 - DNA, 57 bp, Homo sapiens
gggaaatggtactctaatatactgctagtggaagtctatgagagtaccgtttccctt

SEQ ID NO: 24298 - DNA, 50 bp, Homo sapiens
aggggcggggaggtgttagagagttcctccttccccaccctcgcccgact

SEQ ID NO: 24299 - DNA, 81 bp, Homo sapiens
tggcgcgctctgagggaggagccaggagccatttgccttctcattggttgggacctggccctccctcttggccgcgccccc

SEQ ID NO: 24300 - DNA, 65 bp, Homo sapiens
gggggtgctgggggtgctgggggtggccgtgttctcgagtgtcccagcatccgcatcacctccat

SEQ ID NO: 24301 - DNA, 58 bp, Homo sapiens
ccccggggcccggcggcgacttccagctccgccttcgccccctgccggccccggggtg

SEQ ID NO: 24302 - DNA, 60 bp, Homo sapiens
gggccttccgactcccaaggccctaaatggagtcagagccttgagaatcggaaggcccag

SEQ ID NO: 24303 - DNA, 58 bp, Homo sapiens
agggagggggacgagcgcgcggggccgcgtcctcgctcgcgtccccgctccctcctcc

SEQ ID NO: 24304 - DNA, 55 bp, Homo sapiens
gtgcaaaccaggctgggcgtggtgtgagccaccgtgcccagcctggtttgccttc

SEQ ID NO: 24305 - DNA, 76 bp, Homo sapiens
ctccctctacttctgtttatcgctaaagctagtctcttcctcaaattacctctcctacagaactctgtagagtgct

SEQ ID NO: 24306 - DNA, 93 bp, Homo sapiens
cgcagcgggccgggcgggccaggactgcgcctgtgtgcgggtccccaggagcactgctcgcctgccagccccgcccggccgggcccctccggc

SEQ ID NO: 24307 - DNA, 59 bp, Homo sapiens
agcatcaccagtactgttgtttcttgactttttaataatcagcattgtgacttgcatga

SEQ ID NO: 24308 - DNA, 62 bp, Homo sapiens
cgggcggcggccgtcgccttggcctgtcacggtcggaactggcccccgcggctgccctcgct

SEQ ID NO: 24309 - DNA, 78 bp, Homo sapiens
gtggactgcaggaggcggggcagacgggctgcaatagggagccggcccgacgcggaccgcttccctgcagtgccccga

SEQ ID NO: 24310 - DNA, 55 bp, Homo sapiens
cgaagggccggccagggtgccgcagacgcggggacgctggctcgctccctccctc

SEQ ID NO: 24311 - DNA, 59 bp, Homo sapiens
actgcaaaggaagggtcttggaatgatgtgattactctccattccctttgttaggtcct

SEQ ID NO: 24312 - DNA, 65 bp, Homo sapiens
tctgtgctggctcacttcatatgtgtgaattttctcagcacacatatgaaatgagccagcacaga

SEQ ID NO: 24313 - DNA, 68 bp, Homo sapiens
tgttccggcgccaggaggagccgcgcgctgctggtgctgttgccgccgctgctctagctgccgtcagt

SEQ ID NO: 24314 - DNA, 67 bp, Homo sapiens
ggggctccggcgctcgggcgtcggcgacggcgggggcctcgcgcggccgcggcgcgccgggcccggg

SEQ ID NO: 24315 - DNA, 52 bp, Homo sapiens
cccttctggagtgtagctgcagctgcccaagccatggctacggacctgggcg

SEQ ID NO: 24316 - DNA, 60 bp, Homo sapiens
ttaaccagcttgtcactctgtgccccatttaaaaagcatatagtaacaagctggataaag

SEQ ID NO: 24317 - DNA, 55 bp, Homo sapiens
tctctggtctggaagattcctcagtctggaggaggaatcttctagactggaagag

SEQ ID NO: 24318 - DNA, 64 bp, Homo sapiens
gtgcgcgcgcgccaggcccggtgtgacctcgcggaggtgcagaccccggccggcgccggcagtc

SEQ ID NO: 24319 - DNA, 50 bp, Homo sapiens
cccttagggagaacctctgctagggcagtgcagaggtgaaatatggggtt

SEQ ID NO: 24320 - DNA, 73 bp, Homo sapiens
agactccggagggtagagcgctgtgccggttccgctgccgctggccaggagcgcggggacagttcggggctgc

SEQ ID NO: 24321 - DNA, 59 bp, Homo sapiens
gaccagcctgggcaacatggtaaaaccccatctccactatgttgcccatggctggtgtt

SEQ ID NO: 24322 - DNA, 79 bp, Homo sapiens
cggctataagaaccgggaactgggcgcggggagctgagttgctggtagtgcccgtggtgcttggttcgaggtggccgtt

SEQ ID NO: 24323 - DNA, 73 bp, Homo sapiens
gagccgagccgagccgagcgggcgccgcgccgggctcccgccgcagccgcgcttcccggcacccagcgagcga

SEQ ID NO: 24324 - DNA, 52 bp, Homo sapiens
ggggagggaggaaggggtgtcgggctgactccccaccctccgcttcctctgc

SEQ ID NO: 24325 - DNA, 57 bp, Homo sapiens
tcagagagatgccgccttgctcctcctgttcaaggagcaaggcggcatctctctcct

SEQ ID NO: 24326 - DNA, 59 bp, Homo sapiens
ctgcacagagggcggcgggctgttgagggagggggtctgtccgcctctccctgtgccgt

SEQ ID NO: 24327 - DNA, 59 bp, Homo sapiens
agggggaaagttctatagtcctgagatctaattacaggactatagaactttccccctca

SEQ ID NO: 24328 - DNA, 59 bp, Homo sapiens; identical to SEQ ID NO: 24327

SEQ ID NO: 24329 - DNA, 54 bp, Homo sapiens
ctcggctggctgtggcccgcgccaaggtgcatgcccagccaagcagaaggagcg

SEQ ID NO: 24330 - DNA, 85 bp, Homo sapiens
gccgaggggaggagggcgcccggcggagcgttgaatggggcgcagcaaggctcggccgggctttgtgcagcgagcccgcgggcac

SEQ ID NO: 24331 - DNA, 58 bp, Homo sapiens
acagcctcaagctcggccaaggccccaggagcttccttggttggaccttggggctgga

SEQ ID NO: 24332 - DNA, 54 bp, Homo sapiens
gtgcctcaaacatgaaaactccaggtgacaggagtttttatgtttgaggcaggg

SEQ ID NO: 24333 - DNA, 57 bp, Homo sapiens
accgccctggcctgtagaagctactttgtattcagctttacagaccagtggcgttag

SEQ ID NO: 24334 - DNA, 50 bp, Homo sapiens
catcctccactgcagcagtaacgtcgcggcgggttgcgggtaggactgga

SEQ ID NO: 24335 - DNA, 71 bp, Homo sapiens
acaagctcttaggggctcactctgggctggcctaaggccaactgcaggggctgggctctcaggggaggtga

SEQ ID NO: 24336 - DNA, 57 bp, Homo sapiens
gggagcagggtcctcggcctcactaggtcctgtgtggccgatacttcctgcccacga

SEQ ID NO: 24337 - DNA, 61 bp, Homo sapiens
ctgcacagtggctccctggggatggggcccatggccacagagctggagcccctgtgcactc

SEQ ID NO: 24338 - DNA, 67 bp, Homo sapiens
gggcgcgggcggccggccatgatcgcgtcgtgcttgtgttacctgctgctgccggccacgcgcctct

SEQ ID NO: 24339 - DNA, 79 bp, Homo sapiens
tcagcgctccgcccgggcggcatcccgcgcggccaagccggggacagcgcgagccgcagccggagcaggagcgccgaga

SEQ ID NO: 24340 - DNA, 63 bp, Homo sapiens
gggagggcggagcagaagtgaagcgcgaccggacagcgactccaccctgctacgcactcccta

SEQ ID NO: 24341 - DNA, 57 bp, Homo sapiens
agtgcgtagcagggtggagtcgctgtccggtcgcgcttcacttctgctccgccctcc

SEQ ID NO: 24342 - DNA, 54 bp, Homo sapiens
tgcgcgcccgaccgggcccaaccgcctccgcggcccggcccggcccgcggcggc

SEQ ID NO: 24343 - DNA, 67 bp, Homo sapiens
cctgcctcgctctcccaaagtgttgggattataagaatgagcccactttgggaggctgaggcgggcg

SEQ ID NO: 24344 - DNA, 73 bp, Homo sapiens
ataagatacatgctgatatgcacacaatacacatatgatatatgctgattgtgtatctgcatgtgtgttatgt

SEQ ID NO: 24345 - DNA, 50 bp, Homo sapiens
ccgccgaccccgggcgggcgccgggcgcaggagccggggttccggccgcg

SEQ ID NO: 24346 - DNA, 83 bp, Homo sapiens
agctgctcatgccccaggtagctccaggtgagtccccacagtggaggggcttccctggggctgagctggagctgagtggcagg

SEQ ID NO: 24347 - DNA, 68 bp, Homo sapiens
tccggagttgtaagtgttgacaatatccagaatgacattgtctttgtcaacacttacaactctggaaa

SEQ ID NO: 24348 - DNA, 53 bp, Homo sapiens
agccagcctagagccccagcgggaacaggtgtacccgcccggctcctggcccg

SEQ ID NO: 24349 - DNA, 61 bp, Homo sapiens
agagctccagatatcccagtatctggagccacctcgggatactgggatatttggagcttct

SEQ ID NO: 24350 - DNA, 61 bp, Homo sapiens; identical to SEQ ID NO: 24349

SEQ ID NO: 24351 - DNA, 84 bp, Homo sapiens
gccagggcccgcaggaggggaagccgggcctccgcagacaccgcccccgccctgcccgccctcccgccgcgcgggcccgagcca

SEQ ID NO: 24352 - DNA, 51 bp, Homo sapiens
agggggaggagcgacttccgacaaacggatgtcactcctctcccttctccc

SEQ ID NO: 24353 - DNA, 72 bp, Homo sapiens
ctccttggtcctcctgatatctgtgatctcatgaatgggatgatgaagcagactcaggtggtgcaaggaagg

SEQ ID NO: 24354 - DNA, 53 bp, Homo sapiens
cccagcagctgtcagggctgaggaggggccttggctctgggatctgttggaca

SEQ ID NO: 24355 - DNA, 81 bp, Homo sapiens
ccccagtttgcctgggactgaaggtttcccaggtgtgagactttcagcaccaaatctaacagtcccaggcaagccgggtaa

SEQ ID NO: 24356 - DNA, 56 bp, Homo sapiens
accagctgtcgtttctcccttagcttctgtgtatgagagaaacgacttctgttttt

SEQ ID NO: 24357 - DNA, 58 bp, Homo sapiens
ggaggcggaggttgcagtgagctgagatctcgccacttcactgcatactccagcctgg

SEQ ID NO: 24358 - DNA, 60 bp, Homo sapiens
tgcagaggagacaaagcaagcctcatcaggcccattgcttgctctgctctcccttgtact

SEQ ID NO: 24359 - DNA, 60 bp, Homo sapiens; identical to SEQ ID NO: 24358

SEQ ID NO: 24360 - DNA, 54 bp, Homo sapiens
cccgctccccccgggcccgcggcgccaggggagcgctggggagcgctcgcgggg

SEQ ID NO: 24361 - DNA, 78 bp, Homo sapiens
gggcccgcagtctctggagccgcttagtgagggcatcccccgggcctccccggtggcagcagcagcctgcaccccgcc

SEQ ID NO: 24362 - DNA, 64 bp, Homo sapiens
ggccggctgggggaggaggcctgggtctttgggctcccacctgcctcttccctctgccatcagc

SEQ ID NO: 24363 - DNA, 62 bp, Homo sapiens
gcagtggtgggagctgcatccactgctggattgcagtgggcccgctccatccctctctggca

SEQ ID NO: 24364 - DNA, 75 bp, Homo sapiens
cgggggcgcgcgtcccggaggcagcaatccctggcccgcgaggccgcggcgcagccccgccaacgacctcccgcg

SEQ ID NO: 24365 - DNA, 98 bp, Homo sapiens
aggagccaccttccgagcctccagtaccacgtgtcagggccacatgagctgggcctcgtgggcctgatgtggtgctggggcctcaggggtctgctctt

SEQ ID NO: 24366 - DNA, 75 bp, Homo sapiens
agacagagaagccaggtcacgtctctgcagttacacagctcacgagtgcctgctggggtggaacctggtctgtct

SEQ ID NO: 24367 - DNA, 78 bp, Homo sapiens; identical to SEQ ID NO: 17006

SEQ ID NO: 24368 - DNA, 57 bp, Homo sapiens
tcggtggacctcagaacatgtgctgaattcgtgccatatgtctgcggaccacccacc

SEQ ID NO: 24369 - DNA, 84 bp, Homo sapiens
ttggtacttggagagtggttatccctgtcctgttcgttttgctcatgtcgaatcgtacagggtcatccactttttcagtatcaa

SEQ ID NO: 24370 - DNA, 102 bp, Homo sapiens
cccaagtcaggtactcgaatggaggttgtccatggtgtgttcattttatttatgatgagtattacatggccaatctcctttcggtactcaattcttcttggg

SEQ ID NO: 24371 - DNA, 67 bp, Homo sapiens
tttagggcggagccggctcccgctctcctcagtctgcggtgggctagcggacggtccggcttccggc

SEQ ID NO: 24372 - DNA, 73 bp, Homo sapiens
gccgcccgcgccctccgccctgcacccccacctgccgcgggcgggcggagggcacgcccgggcgtgggggcct

SEQ ID NO: 24373 - DNA, 66 bp, Homo sapiens
gccgtgtttaccatgtcactgctgagcctgccacagtgcacaggggtgcatggtaaacacgtgctg

SEQ ID NO: 24374 - DNA, 66 bp, Homo sapiens; identical to SEQ ID NO: 24373

SEQ ID NO: 24375 - DNA, 54 bp, Homo sapiens
gcccgcgcccgccgcagccgcgctctgagccgccgcggccggatcgcagggcgg

SEQ ID NO: 24376 - DNA, 59 bp, Homo sapiens
ccaacgggcgctcctgaccaccaccctggcgggaagggtggccacggggcccgtcgtcc

SEQ ID NO: 24377 - DNA, 60 bp, Homo sapiens
ggtcagtgacgagaaagatgcccggggttaccttcaagctcttgcttccaagatgaccga

SEQ ID NO: 24378 - DNA, 53 bp, Homo sapiens
ttagttcccactggctgtgtaacctaacatagtcacaggctctggggactgtc

SEQ ID NO: 24379 - DNA, 91 bp, Homo sapiens
cgctccccgagcagtgcgcggcgtgggcggaggagcggctccgcgaggagatcgaggcaaacgcggcgcccgcgctgctggaaatcgtgga

SEQ ID NO: 24380 - DNA, 52 bp, Homo sapiens
agaccgacctcaaccccgacaacctgcaggtgcggggctgcgggcgggccgg

SEQ ID NO: 24381 - DNA, 56 bp, Homo sapiens
agggcaggggtggcagagcctggcccgtctggccctagcatccctggactcccacc

SEQ ID NO: 24382 - DNA, 62 bp, Homo sapiens
agggcgcggctcgcggggtgggcggccaggccctggcctctccgactccgcagccgcgatga

SEQ ID NO: 24383 - DNA, 57 bp, Homo sapiens
aggctgtcgggctggggctgaggctgaggctgaggttgaggcggcggcggcggcggc

SEQ ID NO: 24384 - DNA, 56 bp, Homo sapiens
gggatgggcccttgtctgaggctagggctgtggggtcttgggccggccggtccccg

SEQ ID NO: 24385 - DNA, 110 bp, Homo sapiens; identical to SEQ ID NO: 17027

SEQ ID NO: 24386 - DNA, 55 bp, Homo sapiens
aagggatccccagacagccccgagctctgctagctgggcttgtggggacccctgg

SEQ ID NO: 24387 - DNA, 76 bp, Homo sapiens
ggtgggcggcagggcctgggcctgggcacatggggctccctgcctgggtgtgccctgaccccgccctccccacaga

SEQ ID NO: 24388 - DNA, 80 bp, Homo sapiens
tgggggccctgggcaggggtaagctggcaggcagtgccatggcaggccagggtcccctcccatggggtctggcccccgtt

SEQ ID NO: 24389 - DNA, 68 bp, Homo sapiens
tgtccgccccacccggccgggccccgcgcgcagccagcaggggcgctggggtgtgaggggggtttagg

SEQ ID NO: 24390 - DNA, 61 bp, Homo sapiens
aatgcaacccttggacacggtggatcctgggaatctaaccttccgtcccggggctgatgag

SEQ ID NO: 24391 - DNA, 79 bp, Homo sapiens
tctccgcgccccggccccgcgcgcttcgcgacccccaacacctgcggccgggtctgcgtgcgagccgcgcgcgcccagg

SEQ ID NO: 24392 - DNA, 67 bp, Homo sapiens
gcgcgggctgctccggaggctcgggtggcttgagagtcttgggaggctccgggcgctgcccgcgcgg

SEQ ID NO: 24393 - DNA, 54 bp, Homo sapiens
tccctcgcgcccccctgcgtgggttccccgggacgcagggaggtggcaaggagg

SEQ ID NO: 24394 - DNA, 59 bp, Homo sapiens
tggctgagctgagaaccactgtgctaactggggacacagtgattggcagctctacaaaa

SEQ ID NO: 24395 - DNA, 50 bp, Homo sapiens
ggttggtagggcagctggtagaggagtaccagctggtgtgccaattcccc

SEQ ID NO: 24396 - DNA, 64 bp, Homo sapiens
cgcgggtgggggcggcgcgccgcggtggcccggcgtcccgtgtgcgtccagtgtgcgccccgcg

SEQ ID NO: 24397 - DNA, 71 bp, Homo sapiens
tgagttgccggcgccggctgagccagcggacgccgcgttccttggcggccgccggttcccgggaagttacg

SEQ ID NO: 24398 - DNA, 54 bp, Homo sapiens
ggggcgcgcggggtggttcaggggcccatcctctccgcctcccgcgcgccccgc

SEQ ID NO: 24399 - DNA, 55 bp, Homo sapiens
gagtggcccgtccctgggaggctggcaaagtgctctccagggaggggtcagacgt

SEQ ID NO: 24400 - DNA, 77 bp, Homo sapiens
tgggccggaggcgggggagccctcggctgggcgggcgccgagcccggccgggccattcactgcctccgaagcgagcg

SEQ ID NO: 24401 - DNA, 64 bp, Homo sapiens
gccgccgcagcccgcggtgaccgagtgcagcgcgcctgcgctcgccgcgggacacggcaggcgg

SEQ ID NO: 24402 - DNA, 61 bp, Homo sapiens
agtttaatgaagacaggtcagatctgaagtctttgaatctgacctgtcttcactaaactct

SEQ ID NO: 24403 - DNA, 63 bp, Homo sapiens
gagtttagtgaagacaggtcagattcaaagacttcagatctgacctgtcttcattaaactctt

SEQ ID NO: 24404 - DNA, 81 bp, Homo sapiens
tacaatgtaagaagtcactcactcttgggcatgcgctagttcagggttggcagcgacagtgagtgccttcttacattttgc

SEQ ID NO: 24405 - DNA, 72 bp, Homo sapiens
aaacgggctcgtgggcggggttccgcgccggggacgggccgtaggcggagctccgcgccgggagctagctcc

SEQ ID NO: 24406 - DNA, 62 bp, Homo sapiens
ggggtggggtcggtggggctggtggggttgtcgccctgcccctcccggccacctcggccacg

SEQ ID NO: 24407 - DNA, 57 bp, Homo sapiens
gcccagcctctccaggccgaaagctgctggtagtcggggcggagagagccagctccc

SEQ ID NO: 24408 - DNA, 58 bp, Homo sapiens
ttgctgcctcgccccgcggcctctaggagacaggggccacggggagagcacagccacc

SEQ ID NO: 24409 - DNA, 61 bp, Homo sapiens
ggggaggagggaccggagcaccccaggatcgaagagggcgcacgggcccggccctcccacg

SEQ ID NO: 24410 - DNA, 52 bp, Homo sapiens
tcctggcctgaagtgatcctcctgcctggaaggatcacctcaggccaaacgt

SEQ ID NO: 24411 - DNA, 62 bp, Homo sapiens
tcccagggtgcaggccctcggcccgagggaaacccgagtccctagcaggcagcagtggggtg

SEQ ID NO: 24412 - DNA, 60 bp, Homo sapiens
ccccagctggaggccttctccccaggctcactatggggtgggggcttttcctggctgcag

SEQ ID NO: 24413 - DNA, 63 bp, Homo sapiens
aggtgggaggcaggctgctcccatgtggtgagaacagtgggaacagctgggcttccctccttc

SEQ ID NO: 24414 - DNA, 53 bp, Homo sapiens
aagctgacactttgaaaacatgcaaagggtaagttttcagatgtcagctaaga

SEQ ID NO: 24415 - DNA, 66 bp, Homo sapiens
cggggtcccgaagggaaggagaggtgtcaggccttgatctgctggctcctgccagggtccttaggt

SEQ ID NO: 24416 - DNA, 52 bp, Homo sapiens
aggtagatgcctgggctcagaacgcgaacctcagtccagtcatctcccttca

SEQ ID NO: 24417 - DNA, 72 bp, Homo sapiens
acatcctacttccctgtcctcacccagtggaactctggtgtgtgccttgaggataaggaagtagagtggaaa

SEQ ID NO: 24418 - DNA, 64 bp, Homo sapiens
tccgggaccccagagggagtcgtcgcgcgctaggtggaggggacccctctggaatccggcgatc

SEQ ID NO: 24419 - DNA, 80 bp, Homo sapiens; identical to SEQ ID NO: 17118

SEQ ID NO: 24420 - DNA, 62 bp, Homo sapiens
agccgccattgtcgcgctcggagcccctcagctcaggcggccgaggcggaggcagcggcggc

SEQ ID NO: 24421 - DNA, 54 bp, Homo sapiens
ttgctgtgatgatgttctgagctcacccagcctcagttactcaatgacagcaag

SEQ ID NO: 24422 - DNA, 62 bp, Homo sapiens
acgtgacccgacccgcgggcggcgacgcacgcgccgcgccgcgccgctcacgtggtccgtcc

SEQ ID NO: 24423 - DNA, 76 bp, Homo sapiens
tgtgaccctagaataattactcaccctctcaaaaccgagactcagagacgttgggtaattattctagggtcacaca

SEQ ID NO: 24424 - DNA, 87 bp, Homo sapiens
ggaaccgagcctcggcttgcggccggcagtttccgtgggtctgtgaagaggtcggcggcccctgcgggcgccagtcaggtaagccca

SEQ ID NO: 24425 - DNA, 56 bp, Homo sapiens
tggggcgcgctgggcgtcgcccgccggtctaggcgcgcgaacctggcgttcccagt

SEQ ID NO: 24426 - DNA, 58 bp, Homo sapiens
gcctgcgcctggctccgcgggttcgaaacccagccggaccggaccggagggcgggcga

SEQ ID NO: 24427 - DNA, 57 bp, Homo sapiens
ggggcggtgggggcggtcgtggctgcgacgggagccaggcccgcgccaccgcccggg

SEQ ID NO: 24428 - DNA, 65 bp, Homo sapiens
tccctcagggcatagaacagggctttagtaatcccagccctgttctacagccctgagggacacta

SEQ ID NO: 24429 - DNA, 85 bp, Homo sapiens
ttaaaggaatatactaccaagaaaatgtaaaaattatagtcttatttatatagaatgtagtcttagcagtatagtcttagagtta

SEQ ID NO: 24430 - DNA, 56 bp, Homo sapiens
ggtgcctggggctgcagcagcacggggacccggcagtagaaagccccggggacaag

SEQ ID NO: 24431 - DNA, 71 bp, Homo sapiens
cgcgcactgggctgcctccggggctggcagggcagcggcggccgcggcggcggcggggccgggagcgagcg

SEQ ID NO: 24432 - DNA, 52 bp, Homo sapiens
ctgcgagcggcgcgagcctctggcagcgggctcggcctttgctcgcagcact

SEQ ID NO: 24433 - DNA, 57 bp, Homo sapiens
tcatccccagaaaggacttggtgtcatttctggaacaagtcatttctgggggtgccc

SEQ ID NO: 24434 - DNA, 60 bp, Homo sapiens
ttgtgtgctttgtggggaagccataaagcaacacatgccttccccgcaaagcacacgacc

SEQ ID NO: 24435 - DNA, 63 bp, Homo sapiens
ttggttggtgctgtcattggaggcctcatctatgttcttgtcattgaaatccaccatccagag

SEQ ID NO: 24436 - DNA, 55 bp, Homo sapiens
atatagggaataactagtgatttactttgtttaatcacttaatgtttcctctagt

SEQ ID NO: 24437 - DNA, 52 bp, Homo sapiens
ctgagcagggcgcccggctgcgggcccgcgccgcggggagcgccgtccaatc

SEQ ID NO: 24438 - DNA, 80 bp, Homo sapiens
cctccgacacccgcagcaacttctccttggccgcgatgtcctcctcgagctgggggcagcggcgggcgggcgcgggcggc

SEQ ID NO: 24439 - DNA, 59 bp, Homo sapiens
cctcccacccacagggcgagtccaagggaagtatggactcgccctatgggtgggagccc

SEQ ID NO: 24440 - DNA, 73 bp, Homo sapiens
ggcgcgcaggcggcgcaggccggccgcgctcacgttgcggcagaagtccacgtgcaatgtctgcagcgcgcgc

SEQ ID NO: 24441 - DNA, 53 bp, Homo sapiens
tgcgccgcctgcgcgccgcgtgcccgcgcctggccctgcgggcagagcacagc

SEQ ID NO: 24442 - DNA, 58 bp, Homo sapiens
agcggggagagtcggtagcaagaccctctgcgcgtccctaccggctctaccgcgcaca

SEQ ID NO: 24443 - DNA, 55 bp, Homo sapiens
tggtaatatagaaattgaagatatagtctatatcttcagcttctatattaccgca

SEQ ID NO: 24444 - DNA, 66 bp, Homo sapiens
gcaccggccgggcggggcggagaggcgcggggagggggcagagagccagagccggagccggagccg

SEQ ID NO: 24445 - DNA, 68 bp, Homo sapiens
cgagggggatcccggccaggctgcggaagaagagccgcagccatggcaggcggcggtccccggcaggg

SEQ ID NO: 24446 - DNA, 60 bp, Homo sapiens
cggccgccagggaggcggcgggccgcgacatgctggccgccgacctccggtgcagcctct

SEQ ID NO: 24447 - DNA, 80 bp, Homo sapiens
agcgcggccgggaggcggagcgccagcggcggggacacggaggcgtaggccccgcggcctgcgcccgctcgccggcctca

SEQ ID NO: 24448 - DNA, 75 bp, Homo sapiens
cggggcctgccgcggtcgcccaaacttcgcctcaactctcggcgaagttgccggggcgccgggccgggccgcggc

SEQ ID NO: 24449 - DNA, 75 bp, Homo sapiens
ttccgttccccatttcgattgcacagaggaggagtatgatgaagatgctcaggtagtggaagacgaggaggacga

SEQ ID NO: 24450 - DNA, 61 bp, Homo sapiens
gaggcactgactctcagggctcagcctgtattcccacagccctgagggtgagtgcctcctt

SEQ ID NO: 24451 - DNA, 61 bp, Homo sapiens; identical to SEQ ID NO: 24450

SEQ ID NO: 24452 - DNA, 65 bp, Homo sapiens
ctgggcccgcccgcccgctggggtagggggtcctccctgccccggggagggggcatcgccttccc

SEQ ID NO: 24453 - DNA, 61 bp, Homo sapiens
tgggcttacgttgggagaacctcctggttcaccgtaaaagttctcccaacgtaaacccagc

SEQ ID NO: 24454 - DNA, 61 bp, Homo sapiens; identical to SEQ ID NO: 24453

SEQ ID NO: 24455 - DNA, 90 bp, Homo sapiens
gccaatgatgatagcctgacccttgccacagccctgacacttgccacataacagtagggagtggtaatgaggcagtcactcaatatagct

SEQ ID NO: 24456 - DNA, 55 bp, Homo sapiens
tttgttatttctgtattcaagatgtttcctcatctgaatatagaaataacaaaac

SEQ ID NO: 24457 - DNA, 61 bp, Homo sapiens
ctagtcctaaccaagcatgtctaggtctatgaagtgagactgcttgagcccaggactacat

SEQ ID NO: 24458 - DNA, 61 bp, Homo sapiens; identical to SEQ ID NO: 24457

SEQ ID NO: 24459 - DNA, 66 bp, Homo sapiens
cggcaggaggaggacggggaaggacggagccgagccgcggctgcctccctcgctcactccctcgcg

SEQ ID NO: 24460 - DNA, 57 bp, Homo sapiens
gcgtgcatgtgtgtgtgtgtgtgtgtgcgcgcgcacacacacacaacatgcacatgc

SEQ ID NO: 24461 - DNA, 62 bp, Homo sapiens
acctgagatccccatctgacccctcacactgagctgagaggtcagatggggacctcaggtga

SEQ ID NO: 24462 - DNA, 60 bp, Homo sapiens
cgcctcccggctcggcccccacatatcacgctcaagtggaccgatcctgactgaggcaga

SEQ ID NO: 24463 - DNA, 73 bp, Homo sapiens
agcgcaccgcgcgcccgcgtccctggcccgccggctcggttggggcttccgctgcggctgcggctgctgctgc

SEQ ID NO: 24464 - DNA, 53 bp, Homo sapiens
gccccgccgcgcgccgggcaggccccctcgcgcaggcgcgctgccgcgggcgg

SEQ ID NO: 24465 - DNA, 60 bp, Homo sapiens
aggggagccagggtcagtacctttgggccaccatgacctccagccctgctgctccccagt

SEQ ID NO: 24466 - DNA, 81 bp, Homo sapiens
agggtggtggggtaggggcaggctggagagggctggcttgttccaggctgatccatgctggcctgccctcacctgtctagg

SEQ ID NO: 24467 - DNA, 50 bp, Homo sapiens
atcgcgcggatgccagaacgcgctctcagcttcgggtcctgcggctgcgg

SEQ ID NO: 24468 - DNA, 69 bp, Homo sapiens
tgggccaccgcgcgcaggggccggggccgggactggggatggcggcctgcccgcgcgccccggccctgc

SEQ ID NO: 24469 - DNA, 56 bp, Homo sapiens
ccgctgggcgagcgccgcagcgactacgaccgcgaggcgctgctgggcgtccaggt

SEQ ID NO: 24470 - DNA, 75 bp, Homo sapiens
gcggcggcggcggcggtgggtcctggtcccggccccggagggcgcggagtccccacccgcgccgctccggcccct

SEQ ID NO: 24471 - DNA, 64 bp, Homo sapiens
tctaaggtgagcgctggcaggccggcgtgtggcaggcaggcaggccgcgagggctggcaggaga

SEQ ID NO: 24472 - DNA, 84 bp, Homo sapiens
ccagtcacgtccccttatcacttttccagcccagctttgtgactgtaagtgttggacggagaactgataagggtaggtgattga

SEQ ID NO: 24473 - DNA, 62 bp, Homo sapiens
ccgcgccgctgggggctctgactcctgccgagccgggcctgggcagcgccccccgcgccccg

SEQ ID NO: 24474 - DNA, 96 bp, Homo sapiens; identical to SEQ ID NO: 17239

SEQ ID NO: 24475 - DNA, 56 bp, Homo sapiens
agctcatccatagttgtcactgatttgagacagtgacaactatggatgagctctca

SEQ ID NO: 24476 - DNA, 56 bp, Homo sapiens; identical to SEQ ID NO: 24475

SEQ ID NO: 24477 - DNA, 75 bp, Homo sapiens
ccaggcggcggtcgggggaagtggctgccgcctctggcggcggccagggtccgccaggctgcagggccgggcccc

SEQ ID NO: 24478 - DNA, 62 bp, Homo sapiens
ggagcagcagcggtgaaggccctcggctcggccgagaccgccgtgcccactgctcgcctcgg

SEQ ID NO: 24479 - DNA, 82 bp, Homo sapiens
ccaacatgcttcccaaaggtgagtgggccctgcctgcggccacagggccagggggcaggcaccctgggctggggtgtggggc

SEQ ID NO: 24480 - DNA, 87 bp, Homo sapiens
gttacctggtagtgagttagagatgcagagccctgggctcctcagcaaacctactggatctgcattttaattcacatgcatggtaat

SEQ ID NO: 24481 - DNA, 54 bp, Homo sapiens
gccgcttgcgggtgagctctgcccaagccgaggctgcggggccggcgccggcgg

SEQ ID NO: 24482 - DNA, 71 bp, Homo sapiens
ggggctgacggcacggggcggggcctcggggaccccggcaagcccgcgcacttggcaggagctgtagctac

SEQ ID NO: 24483 - DNA, 73 bp, Homo sapiens
acctcggcgcgctcccggccgctcgctggctccggggccgcggcggctcctctgccgggtcgcgccggacgac

SEQ ID NO: 24484 - DNA, 73 bp, Homo sapiens
gccgctgggggtttggggcggctgcacgctccggggtggggggatgcgggagcccggtcaggcccagccgcct

SEQ ID NO: 24485 - DNA, 50 bp, Homo sapiens
agaggtatttttcagcagaccaagtaagtcagctgtaaaatacctcttgc

SEQ ID NO: 24486 - DNA, 54 bp, Homo sapiens
attgcgagtcaccgagtttcccgcgcggcttgaggtactggggaaccggaatcc

SEQ ID NO: 24487 - DNA, 50 bp, Homo sapiens
ggcggcgtgggcgcggtgatgcaggtgtgacacccgccggcgcctgcctc

SEQ ID NO: 24488 - DNA, 65 bp, Homo sapiens
tgaaaggggccgccttatctgagcagccctttcctgggggtagagatgacggggctctctgcacc

SEQ ID NO: 24489 - DNA, 60 bp, Homo sapiens
aggcctgctctgggccgccctgcctcccccagaggctgcagggagccccaagcaggcgca

SEQ ID NO: 24490 - DNA, 55 bp, Homo sapiens
ctttcactacttctctgacaggatgggcattttggacattgaagtgtggggaaag

SEQ ID NO: 24491 - DNA, 54 bp, Homo sapiens
cgggaggagggcggatgatggatggcctgtctgccggcccgggtccgagccgcg

SEQ ID NO: 24492 - DNA, 75 bp, Homo sapiens
ttagtctagcacctggtcaattcagtcaaaaatgtcaaaaaccctgtgaccgaattgacaggtgttagactgact

SEQ ID NO: 24493 - DNA, 71 bp, Homo sapiens
aactgatctcggagttaaggcgaattgttcaagaacacaaactacatcgcactcgtcagttgtcagttctg

SEQ ID NO: 24494 - DNA, 68 bp, Homo sapiens
cacgcgccgcgtcaccgggccgctcccggcctgggctcccgggggctggtcagggaggtggcggcggc

SEQ ID NO: 24495 - DNA, 79 bp, Homo sapiens
gcttcctggggttgcggggcggcccagcgaggcttcaccctcctcgatgtctgggtcacgcttcttgcccaggtggtct

SEQ ID NO: 24496 - DNA, 69 bp, Homo sapiens
cgctcggcgtcggtgcctgagggaggccgcgatggcggccgaggccctggcggcggaggccgtggcgtc

SEQ ID NO: 24497 - DNA, 62 bp, Homo sapiens
gcggtcgggtgagaggccgcggcggcaggtgagtgagcgcggcctcgtactcgcgcgtgcac

SEQ ID NO: 24498 - DNA, 54 bp, Homo sapiens
cggggcggggccgggcgggacgtcggtcatccccgccggcctcgccccgcagcc

SEQ ID NO: 24499 - DNA, 56 bp, Homo sapiens
ggggggggaagcgggggcagacagaggacagctctgatgccctcgccctccctagt

SEQ ID NO: 24500 - DNA, 74 bp, Homo sapiens
ctcgggtgagtggggccgcgcgccccggcggggacgcggaggggaggaaggggcgcgcgccgctcggcctttgt

SEQ ID NO: 24501 - DNA, 90 bp, Homo sapiens
tggcctctccagtctgcagctcccggcagcctcgggccacactcccgggatccccagggactggcctgggactaccgggggtggcggccg

SEQ ID NO: 24502 - DNA, 58 bp, Homo sapiens
gcccccccatagccctcagcaccagggctggccactgttggggtagatccgggtcctg

SEQ ID NO: 24503 - DNA, 77 bp, Homo sapiens
ggggatggtgccgtcctgacctggcccaggtccagtctccgggctgggggctcacagggtgacggcatggtcccagg

SEQ ID NO: 24504 - DNA, 79 bp, Homo sapiens
ccaccccccgacgcacctgctcctggatgagctgcagcagcgagctcctgtccatagagcctggccgggggccggggtc

SEQ ID NO: 24505 - DNA, 68 bp, Homo sapiens
tcgggctgcggggctccggctgcgggcgctgggccgcgaggcgcggagcttgggagcggagcccaggc

SEQ ID NO: 24506 - DNA, 67 bp, Homo sapiens
ggcagggtggggttcagaggcggatggaggacagactcagagcctccgctggtccctgccttccagc

SEQ ID NO: 24507 - DNA, 50 bp, Homo sapiens
gctcgccgcgggcacccgcacaataacaaaccccggcgcgcggcgggcgg

SEQ ID NO: 24508 - DNA, 64 bp, Homo sapiens
gagccaccatgccccgtgagacaagtttattagaaatgactctgggctgggcgtggtggcaggc

SEQ ID NO: 24509 - DNA, 87 bp, Homo sapiens
gggccttggggccccgggaggtggaggtggtcccattccagtgagggcagtggacgtgccagggtcttctggggcccagaggctgga

SEQ ID NO: 24510 - DNA, 81 bp, Homo sapiens
gcgttaggccccgccccgcgcgccccgcccgcgccagggtcctcggagctgctctggctgcgcgcggagcgggctccggag

SEQ ID NO: 24511 - DNA, 53 bp, Homo sapiens
ggcctcgcggggccccggctgcaggtggctgccccggccccgcgccaggcgca

SEQ ID NO: 24512 - DNA, 80 bp, Homo sapiens
tgggggtgaggggaacgggtgggagaggagatggggcaggggagggctccatggctccccaccgccatcccctcctcagg

SEQ ID NO: 24513 - DNA, 79 bp, Homo sapiens
tggggaggggagccggcaggaggtggggggccatcaccaggccccggacccatcgttgcctggccacacctcctccagc

SEQ ID NO: 24514 - DNA, 68 bp, Homo sapiens
tgcagaccccacagggtgtctggatgcctgggccatggccttggcctccctgaggccctgtctgtgtc

SEQ ID NO: 24515 - DNA, 65 bp, Homo sapiens
gagttggtggtgggcatggtgccctgtgtccagctggcacccgagccggccgcctgccttccagg

SEQ ID NO: 24516 - DNA, 78 bp, Homo sapiens
cgccgtccgtgaggtccccaccggccgccgtagccggaactgctgctgagggcggcgggccggcttcgctagggtgag

SEQ ID NO: 24517 - DNA, 82 bp, Homo sapiens
tggggtgggcacgggcagggggcccaggcgggctcctggggactcgccggctgttctgggctgacagctctcccacccctcc

SEQ ID NO: 24518 - DNA, 55 bp, Homo sapiens
ggtaagggaggcgtgagggcactagcaggttgctccctgtgccctcccctgcaga

SEQ ID NO: 24519 - DNA, 63 bp, Homo sapiens
ctggctgggcgagcgggaggctggggagtgccggtgacacccgacctcggccctgcccttgca

SEQ ID NO: 24520 - DNA, 56 bp, Homo sapiens
cctctgtagcgggcgacctaggccgcgggacccggacggaggtagaggccagggca

SEQ ID NO: 24521 - DNA, 58 bp, Homo sapiens
cggctagagcggtggccctgatagaggccgctctaccatgagccgaccgctcgaaggt

SEQ ID NO: 24522 - DNA, 75 bp, Homo sapiens
gtcgcgcttccggcggcgtcccggggccaggggggtgcgcctttctccgcgtcggggcggcccggagcgcggtgg

SEQ ID NO: 24523 - DNA, 61 bp, Homo sapiens
tatgccgagctctgccagagctcctgggggtcaccttgggcctggtggtgctcggggtagc

SEQ ID NO: 24524 - DNA, 68 bp, Homo sapiens
cgccacccctctccggcagggcatggtcctggggctcctgtgccgtgtatgacagcgggggctacgtg

SEQ ID NO: 24525 - DNA, 61 bp, Homo sapiens
aggtatctccggcccaaagctctgtgaaatccagattcagtgcttccgcggggatttctga

SEQ ID NO: 24526 - DNA, 55 bp, Homo sapiens
ggcgtgagtgggcggggcgggtctggccacgcccaccccgaccaggacacgccca

SEQ ID NO: 24527 - DNA, 72 bp, Homo sapiens
gggggcggggcagcgggggcggggcagcgcggcctgaggatgtgcggacctgactgcgcccttggcccccag

SEQ ID NO: 24528 - DNA, 85 bp, Homo sapiens
cgggcggcggcggccggcgggcggcgatggcggcggcggaggccggtggcgacgacgcccgctgcgtgcggctgagcgccgagcg

SEQ ID NO: 24529 - DNA, 94 bp, Homo sapiens
gtgaggtgtgggcccggccccaggagcggggcctgggcagccccgtgtgttgaggaaggaaggcagggcccccgctccccgggcctgaccccac

SEQ ID NO: 24530 - DNA, 68 bp, Homo sapiens
actgcgcctgtctgtggttcctgccagtgtgtgtacacgggggcgctggagctatgcacaggccgtgg

SEQ ID NO: 24531 - DNA, 66 bp, Homo sapiens
tcatcagccgggagaagcggggcgcgcaccccgaggcccacctccgctccttcgaggccgatgcct

SEQ ID NO: 24532 - DNA, 72 bp, Homo sapiens
agttggagcccgttgcggcccctgaggaagcgaggaggcgtcggcgtcggctgaggcgggcggaccggcgag

SEQ ID NO: 24533 - DNA, 60 bp, Homo sapiens
aggagaagtggcaggtcacgctctagaaccccagctagacgtggccgctcacgctccaga

SEQ ID NO: 24534 - DNA, 60 bp, Homo sapiens; identical to SEQ ID NO: 24533

SEQ ID NO: 24535 - DNA, 62 bp, Homo sapiens
aggcgatccagatccagaacgccaccagtaacccgccgtcgttcaaggtctagaacgccaac

SEQ ID NO: 24536 - DNA, 61 bp, Homo sapiens
cgggtcggggtggcggcggcggcctgggtcgcggggtcgacgctcgctgctgcagcggcag

SEQ ID NO: 24537 - DNA, 59 bp, Homo sapiens
gcctgggtggcagggctgggggtctgatttgtatcccccagccaggccccaccaggaat

SEQ ID NO: 24538 - DNA, 56 bp, Homo sapiens
agaggccggagggcgcgcgcactgctaggaagtgctggtcccccgcgccgctctgc

SEQ ID NO: 24539 - DNA, 64 bp, Homo sapiens
tcggggaccgagcctgaagcctcaactaccagtcgcgttgctccgcttcaggtcggtccaggtc

SEQ ID NO: 24540 - DNA, 54 bp, Homo sapiens
agggccacatagtcacatagtcacatagtcacatgtgtctgtgtctgcccagcc

SEQ ID NO: 24541 - DNA, 55 bp, Homo sapiens
gcgagcgagcgaggggaggggtggaggccgccccccgcgcccctcctcctcgccc

SEQ ID NO: 24542 - DNA, 71 bp, Homo sapiens
tcggagccccacactacaccacagggatgagcgtgtatccccttcagaggtgtgcctggggactccgtgtg

SEQ ID NO: 24543 - DNA, 73 bp, Homo sapiens
ttggtgtgcaggggacggcaggggcagtactgggtgagctgtgtgactggtggtgactctgctccttcccagg

SEQ ID NO: 24544 - DNA, 54 bp, Homo sapiens
cgggcgggccggcggggcggcggggccgggcgcgaccgccgggtctgtcccgca

SEQ ID NO: 24545 - DNA, 52 bp, Homo sapiens
agattcctgggcctgcccctagacacttccaggttggggcccaggaatctgc

SEQ ID NO: 24546 - DNA, 58 bp, Homo sapiens
cccggtgcccgcacgcgtgcgtctgcgcctttgcgcgcgcggcggcccccgcacctgt

SEQ ID NO: 24547 - DNA, 70 bp, Homo sapiens
cccagaggggcagctctgagagtgccccaaaggacaagggactgggattctcagtggtgacctttggggc

SEQ ID NO: 24548 - DNA, 78 bp, Homo sapiens
ccggagcatgcgcgagagccgccccggagcgccccggagccccccgccgtcccgcccgcggcgtcccgcgccccgccg

SEQ ID NO: 24549 - DNA, 83 bp, Homo sapiens
gacgccggggcgcggggaccagcgggagacagcggggggccggtggcgccagcacctgctgggggccccgggcactgagccct

SEQ ID NO: 24550 - DNA, 73 bp, Homo sapiens
agcttgtcggatgtgcagatttcaggccccatcccagacctgctgcatgagaatctgcatgttcacaggcccc

SEQ ID NO: 24551 - DNA, 78 bp, Homo sapiens
gcggcccgaggggcgggggcggcgggcggcccggggctgcaaagcggggggccgccgcctccctgggcctgcctgggc

SEQ ID NO: 24552 - DNA, 52 bp, Homo sapiens
tctgattggtcgcagaaagcaactgcaaaagctttctgcgaccaatcagact

SEQ ID NO: 24553 - DNA, 56 bp, Homo sapiens
tagcttattaaggaccagctttgcaggtgactgcgccatgctgagaatcgctgttc

SEQ ID NO: 24554 - DNA, 70 bp, Homo sapiens
ggacctgcccgccgagccggctgcagcccgaggaggaggaggaggcggcggcggaggaggaggaggacgg

SEQ ID NO: 24555 - DNA, 54 bp, Homo sapiens
aaaagagcaagggagacagcccttgacggcagtctgtctcttttctctttaggt

SEQ ID NO: 24556 - DNA, 59 bp, Homo sapiens
attggtggctagatttggggtgcaagcttcttaggctcataccatttcaactaccaaga

SEQ ID NO: 24557 - DNA, 78 bp, Homo sapiens
cttgggaactcttaatatgtcttttatatgcctcttctttttttgtctttaataagacatattaagagttctcaggac

SEQ ID NO: 24558 - DNA, 71 bp, Homo sapiens
gtactgacgctcatgctcagagcgactgtcctgttggaggagggcagggtgtgagaggagcctcagctgat

SEQ ID NO: 24559 - DNA, 56 bp, Homo sapiens
ggactgggtgagggtgttggttggtggcacttacaatacaaacatcccctccatag

SEQ ID NO: 24560 - DNA, 61 bp, Homo sapiens
ggtgtcggcggcggcggcggcggcggcggcggcggcggcagcgggtcggtgtagaaaatgg

SEQ ID NO: 24561 - DNA, 59 bp, Homo sapiens
gacattctccactgatgtactgagacttatatcagtagtacatcggttgagaatgtcct

SEQ ID NO: 24562 - DNA, 69 bp, Homo sapiens
cgtggcccgtcggccccccgggggcaccagccctcccaacggcggcctcccggggccgctggccacctc

SEQ ID NO: 24563 - DNA, 75 bp, Homo sapiens
tctccgcgacccggccctggcgcccgagaggattcctgggtgggggtgggcgtggagggccgggggctggagagg

SEQ ID NO: 24564 - DNA, 53 bp, Homo sapiens
gcggggaggggagagaggctggccttgacctctctttctttccttcccacaga

SEQ ID NO: 24565 - DNA, 74 bp, Homo sapiens
cccggacggaggatggggggattgccgagcctcggccgaagattcccgagtcggcccccggccccggccccggc

SEQ ID NO: 24566 - DNA, 54 bp, Homo sapiens
ggggccgtggggggcggggcggcctgctatcggccccgcctctctcggccccgc

SEQ ID NO: 24567 - DNA, 62 bp, Homo sapiens
ggaggtagctggtgctgggctcctagtcttggcagaggagcccaaagcacttggctgccctg

SEQ ID NO: 24568 - DNA, 61 bp, Homo sapiens
ggagggcgggggcgggggagaccgggtacccccgagaccctgtcccctatcgatcctgtcc

SEQ ID NO: 24569 - DNA, 89 bp, Homo sapiens
ccccggcggccgagcccctccaggtggacttgctcccggtgctcgccgccgcccaggagtccgccgcggctgctgcggccgctgccgcc

SEQ ID NO: 24570 - DNA, 76 bp, Homo sapiens
tgggctccctctcgggggcggagggggtgcctgtgagctctcagccacttccctcccaaccctggtgagctccaag

SEQ ID NO: 24571 - DNA, 74 bp, Homo sapiens
ggcactggagcctgggtcaggggagctcaggggcttacctgttgataagctcctctgtcctctccctttcccag

SEQ ID NO: 24572 - DNA, 57 bp, Homo sapiens
atcgggagatgatgggaaaccctagctaactagtccttcccctctgtttcctgtatc

SEQ ID NO: 24573 - DNA, 62 bp, Homo sapiens
cggcggctccagggacctggcggccgccgatcggggctgcgaggccccatggcgccgccccc

SEQ ID NO: 24574 - DNA, 62 bp, Homo sapiens; identical to SEQ ID NO: 24573

SEQ ID NO: 24575 - DNA, 72 bp, Homo sapiens
ggagcagcggcgccgccgaggtccaggcggcgacgcgccccgggccctgttggccgccccgcgcggctcctc

SEQ ID NO: 24576 - DNA, 61 bp, Homo sapiens
gggagggcagtggggtgagcatgagcctcaactgagcatgtctgccatcctgccccacagc

SEQ ID NO: 24577 - DNA, 60 bp, Homo sapiens
cgcgaggctgtcggcgcgcgcccatagagacagactgagggggtcaggccggccggcgct

SEQ ID NO: 24578 - DNA, 57 bp, Homo sapiens
ggggcaagcggctcaaggttgaggacccttgcccttagccaggcctctcctgcccca

SEQ ID NO: 24579 - DNA, 58 bp, Homo sapiens
cggggcgagctgccccgcggcgctcaggccgagcccccgggcagcagctggcccaggt

SEQ ID NO: 24580 - DNA, 58 bp, Homo sapiens
ggtgggggaccccaggagactcaagcctctgaagcctcctgtcctgtccccctgccca

SEQ ID NO: 24581 - DNA, 64 bp, Homo sapiens
actgaccagcccctgcggcccacgctcgcattcctgcacccggtgggccgttcgggctggctcc

SEQ ID NO: 24582 - DNA, 74 bp, Homo sapiens
tgggtggcttggctggcttggccggctgggtgtcttggctgacttggctagcttgtccggctgggtggcttggc

SEQ ID NO: 24583 - DNA, 74 bp, Homo sapiens
gcggtgggcccgcgggggagtccgttcgggaggggcccgcccctccctcgcctcccccgccgactccatcccct

SEQ ID NO: 24584 - DNA, 60 bp, Homo sapiens
cgtcccggtcgccgcggttcgccgccgcccctggtggcggtccggcgaccggcccaccat

SEQ ID NO: 24585 - DNA, 58 bp, Homo sapiens
caaaagtaatcgtggtttttgccattgaaagtagtggctgaaaccacaattgctttgc

SEQ ID NO: 24586 - DNA, 53 bp, Homo sapiens
ccgggggccggcggcggcgacgccccctcagcttgctgccgctgctcccaagc

SEQ ID NO: 24587 - DNA, 75 bp, Homo sapiens
catctggctggcgggcccgcagcccacccaagggcggcaccagctgtgggctcgacgccgccgtccccagcgctg

SEQ ID NO: 24588 - DNA, 70 bp, Homo sapiens
gggagcccggccggcgccggcggcgtcgctcccgccctcgggggctccgcgggccctccccccctccctc

SEQ ID NO: 24589 - DNA, 61 bp, Homo sapiens
accctggagggtggggggaggcggctgtcgtgagaggtcccagccccacatcttccagtga

SEQ ID NO: 24590 - DNA, 60 bp, Homo sapiens
actggcaaaagggtttagaacttgactgccctataaagagttcttcctctgtgccatagg

SEQ ID NO: 24591 - DNA, 78 bp, Homo sapiens
ctgttgcgtcgtgtggaggtgagggccgggcggccagggcgtgggaaggcgggccctcttccccgtcccgcgcgaggt

SEQ ID NO: 24592 - DNA, 55 bp, Homo sapiens
atcggggttctctgactcactctgtaccctcgaatgagtacgggatctctgtaga

SEQ ID NO: 24593 - DNA, 57 bp, Homo sapiens
ggcccgcggagccgggtgcgcagagccgctggcgcactcgcgcgctgcgctggcctc

SEQ ID NO: 24594 - DNA, 79 bp, Homo sapiens
tggggggcagtctgggaaggcttcctggaggagatgtgggcacactcccctctctaccttcccacactggcccaccagg

SEQ ID NO: 24595 - DNA, 62 bp, Homo sapiens
agcgcagggcagcaatgacgtcccccagagccgacagcgacttgttgatgtgctgcgcctcc

SEQ ID NO: 24596 - DNA, 62 bp, Homo sapiens; identical to SEQ ID NO: 24595

SEQ ID NO: 24597 - DNA, 68 bp, Homo sapiens
cccctccccgaggcccgcggcgccgccgcctccacctcgctcgagccgcggagcgcctccgagcggcc

SEQ ID NO: 24598 - DNA, 90 bp, Homo sapiens
gtctggttggggggaaggctggcttccatcttctcttccttttaggggatggggagaaggaacaggctctccataagcccagccatgccc

SEQ ID NO: 24599 - DNA, 71 bp, Homo sapiens
aggggacggaagggcagagagggccaggggctgtatgcactttctccctgagcccctcctgcccccccact

SEQ ID NO: 24600 - DNA, 73 bp, Homo sapiens
gtgggatgggcccgcgaccgcggcctcggcgtcctgtagtacctgacggcggcgagcggcgtcaatcccacca

SEQ ID NO: 24601 - DNA, 72 bp, Homo sapiens
gagtccgggggcttggcggtggtgcgaggctcaggggtcggccctggctccacctctgagccccggactccg

SEQ ID NO: 24602 - DNA, 86 bp, Homo sapiens
gtgagcagcggggagggacggggagctggaggggagccgagagtatcgagcaggcactgaagctgcggtccctccctctcctcagg

SEQ ID NO: 24603 - DNA, 54 bp, Homo sapiens
tggggctccaggcctgggtgctggcccacagcaggcatggcccaagcccccggt

SEQ ID NO: 24604 - DNA, 74 bp, Homo sapiens
ggcgtgggagggttgggctgggcatgggccacggctgcccccacagagcccacccagctgagccgctcacccag

SEQ ID NO: 24605 - DNA, 81 bp, Homo sapiens
cgctgtttctatcatggccgcgggagccgggacggcgggccccgcttccggcccgggcgtcgtgcgtgacccagcggcgtc

SEQ ID NO: 24606 - DNA, 61 bp, Homo sapiens
gggaacagcagcaacatgggcctcgcttcctgccggcgcggcccgggctgctgctgttcct

SEQ ID NO: 24607 - DNA, 63 bp, Homo sapiens
gccacggcaggtagcgagcgctggcgcggggggcgcggtgggctggctgcctgcacggggcgg

SEQ ID NO: 24608 - DNA, 57 bp, Homo sapiens
aggggtgccacgctgccgccagcccagcactcaggaagcgcagtgctgcacaccacc

SEQ ID NO: 24609 - DNA, 105 bp, Homo sapiens
agtgcctcctggtccctgtctgccggcattcgcggctgcggggcccggaggtgggactggcttcccggtgccgcgagggcgggtccggacagccttccccccagt

SEQ ID NO: 24610 - DNA, 105 bp, Homo sapiens; identical to SEQ ID NO: 24609

SEQ ID NO: 24611 - DNA, 82 bp, Homo sapiens
atgttgggatgaggggagggtcgagaggaaaggagggctccctcctggtgcctccgtctcctgccctaggtccgggaggtgc

SEQ ID NO: 24612 - DNA, 54 bp, Homo sapiens
cagaactcttctaagcccttcctccattaaggtggaagggattgaagactttga

SEQ ID NO: 24613 - DNA, 73 bp, Homo sapiens
gcggctgctcagcccggggccccggcgcctctcggggtggggcaaagttgggggccgggagcggcgggggcgg

SEQ ID NO: 24614 - DNA, 71 bp, Homo sapiens
aagattcagtgagtgttgtccaaagacctcgaggatttggggtcattggcaagaacttccattgtacattt

SEQ ID NO: 24615 - DNA, 72 bp, Homo sapiens
gggtcatatggtaattctgtgtttaacttttggagggaaccaccaaactatttccacagtggctaaaccttt

SEQ ID NO: 24616 - DNA, 57 bp, Homo sapiens
ccgctgccgtgctgtgggcgccccgagtctgggcggggtcccgggtgcgcagcctgc

SEQ ID NO: 24617 - DNA, 54 bp, Homo sapiens
acttttgcagtttttgccagtacttaaaagtaatggcaaaaactgcaaaagtaa

SEQ ID NO: 24618 - DNA, 80 bp, Homo sapiens
cgggcggcggcggcgggcggcggggaccgggccggggccggggccgggcgcaatccggagttgccgagcccgcggcggcg

SEQ ID NO: 24619 - DNA, 59 bp, Homo sapiens
atcccagggccagtctccacttcactcttgggaaggcgaaggctggtcagggagacaca

SEQ ID NO: 24620 - DNA, 60 bp, Homo sapiens
tgaggttcagccaggaggaggggtgatgtttgagaggccctcccatagctgtgcttcagt

SEQ ID NO: 24621 - DNA, 60 bp, Homo sapiens; identical to SEQ ID NO: 24620

SEQ ID NO: 24622 - DNA, 61 bp, Homo sapiens
ctcggggcggggccgcggtctgcgggaggagcggctgcaggcccgggaatccggcccggct

SEQ ID NO: 24623 - DNA, 56 bp, Homo sapiens
caggagctgtgcccggtgcctgcagccttcataagcacacacgtccattccctact

SEQ ID NO: 24624 - DNA, 64 bp, Homo sapiens
gggaggggccggggcgcctgggggccccgcagccgctcacgccgccccccggccccgcgccccc

SEQ ID NO: 24625 - DNA, 64 bp, Homo sapiens
cagcatgagggctgtggatgccaaggccagtatctgccgtggcggccacagccctcatgcctcc

SEQ ID NO: 24626 - DNA, 83 bp, Homo sapiens
cccgcctcggcctcccaaagtgctgggattacaggcgtgagccactgtgcccggccagcttcaggaattggctgggtgttgtg

SEQ ID NO: 24627 - DNA, 55 bp, Homo sapiens
aggttcggtcttggagctccgtcttcggcagcgggctcgggggcctcggactctg

SEQ ID NO: 24628 - DNA, 58 bp, Homo sapiens
catcaaggggcagttaaagggagtggactgcccctccctttaactgccccttggcagt

SEQ ID NO: 24629 - DNA, 61 bp, Homo sapiens
acaggcgctgcggagacactgagcactgccctcgcggctgtcacgtctgcggctgtcacgt

SEQ ID NO: 24630 - DNA, 78 bp, Homo sapiens
cggcggccgacgacgctcaggcccggccccgccccgtgcctccagcccgccaggagcgccctcgcagtggccgcctgc

SEQ ID NO: 24631 - DNA, 73 bp, Homo sapiens
acctccagccacagctcccagtgtggcttgggcactcctcagcctcgccgggccccaggcttcctggtggtgg

SEQ ID NO: 24632 - DNA, 73 bp, Homo sapiens
gcgtgcagctcgtagagcttgcggcgtctgcgcgtgcgcacaggcgcggcgggagagggggccgggggcgcgg

SEQ ID NO: 24633 - DNA, 58 bp, Homo sapiens
cagccgcaggcgcccggtccgactgctgcttcggttcaccgggcgacctgcggccctg

SEQ ID NO: 24634 - DNA, 73 bp, Homo sapiens
tcggccgtgatgcctcacacccaagtgctgcctcgagcatgcgtctcctgggtgagggtgtctgagcccacag

SEQ ID NO: 24635 - DNA, 73 bp, Homo sapiens; identical to SEQ ID NO: 24634

SEQ ID NO: 24636 - DNA, 54 bp, Homo sapiens
aagggctggtgggcggctgggcgggcgagtacccggctgccccctgacccttgc

SEQ ID NO: 24637 - DNA, 56 bp, Homo sapiens
ggaggggacctggggggctcccccaatggaggccgagcccggccaggcccaccttc

SEQ ID NO: 24638 - DNA, 68 bp, Homo sapiens
ctggggggctctgggctgtgggggcctgtttttgtgacttaaagctctcccagcacagccccctgacc

SEQ ID NO: 24639 - DNA, 83 bp, Homo sapiens
gcctgcgatgtagtcgatgcggcccccgtgggtcgccttcaggtgtcgcgccaggaggccgatggcggcgcggaaggaggcgg

SEQ ID NO: 24640 - DNA, 52 bp, Homo sapiens
tggcccctctgcccccacccagagctgctggaactgcgggcggaaagccagt

SEQ ID NO: 24641 - DNA, 57 bp, Homo sapiens
tgcccccgtgatcctgcacgtgggacgtcagccacctgtcaggacacctggggcaga

SEQ ID NO: 24642 - DNA, 55 bp, Homo sapiens
cgctgtcttctggcgccgcaccgggctcaggcgcgcggcggggctggggcgcgcg

SEQ ID NO: 24643 - DNA, 54 bp, Homo sapiens
tccgcctccagcctccgggccgaagctttggcctatggtgcggggaggtagtag

SEQ ID NO: 24644 - DNA, 67 bp, Homo sapiens
acgtcgttaccaccgctgggtctgtggcggtttgtccgcaggcgctggtgttctggaaatgacgtcg

SEQ ID NO: 24645 - DNA, 61 bp, Homo sapiens
gctgcagtcaggtcctctgttcctcgcgctggcggggtcagcagacgtctggccgcagtga

SEQ ID NO: 24646 - DNA, 58 bp, Homo sapiens
aggcccgaactgatccgcggcggccggagaccgctggggacagacaggtagcgccgtc

SEQ ID NO: 24647 - DNA, 69 bp, Homo sapiens
ctggagagaaaggcagtcagaggagaaaatgaggtccagctcgtccctggctctctctctctctcaggt

SEQ ID NO: 24648 - DNA, 56 bp, Homo sapiens
gggtcctggaggggcttggaggccccagtctcgcagccccttcatcggggaccccc

SEQ ID NO: 24649 - DNA, 79 bp, Homo sapiens
cgtggtttcagcaacttccacaagggggtggggttagaaggttctctcccatccttgtcaaagttgctaaaaccacgca

SEQ ID NO: 24650 - DNA, 76 bp, Homo sapiens
ccctaagccttatagcaacaccgtaggacccagatgaactgctacggatgatgctggaagtgctcccaaaaagcaa

SEQ ID NO: 24651 - DNA, 60 bp, Homo sapiens
gggactggcagccgggactgagcgctccacaggcgccttctctccagcgccgcgtcccgt

SEQ ID NO: 24652 - DNA, 66 bp, Homo sapiens
acctgctgtccctcttcaaggcaggtctagacgcctggttctccttggagagtgggcagcagagac

SEQ ID NO: 24653 - DNA, 52 bp, Homo sapiens
caagctcaagttgggcaccccacactctagaccagtgcctcccaacgttgac

SEQ ID NO: 24654 - DNA, 63 bp, Homo sapiens
ctgctgtgaagctgaaaccggagccggtccgctgggcggcgggcgccgggggccggaggggcg

SEQ ID NO: 24655 - DNA, 69 bp, Homo sapiens
cgcgggccccttcccggcagcctccctcgggcagggagcgcgtcatttccggagggggaggcccgcggc

SEQ ID NO: 24656 - DNA, 59 bp, Homo sapiens
tcgtctgggccccggttcctggacgacctgggacttctaggcagcgactcccagacaga

SEQ ID NO: 24657 - DNA, 60 bp, Homo sapiens
tagtgtccgtgccgggtgcctgcggggaatgggagtggcaaccccgggctgatcactact

SEQ ID NO: 24658 - DNA, 64 bp, Homo sapiens
ccggcgcggcgaccgcggcgagggcggcggggacggagcagagcacgacgaagacgcacaggca

SEQ ID NO: 24659 - DNA, 76 bp, Homo sapiens
ggcggggcaccgagggccccccggagccccgcccagcgcctgcctcgctccgcccccgcccccggagccccgccca

SEQ ID NO: 24660 - DNA, 63 bp, Homo sapiens
tggggtgggaggggtgatgagcccctgttatctgaggagctcagggcctgctcccaccccgca

SEQ ID NO: 24661 - DNA, 60 bp, Homo sapiens
gcgcgccaggagctgcgcgggcgctgggagggagaccagggcgcagttccgggcgcgtct

SEQ ID NO: 24662 - DNA, 74 bp, Homo sapiens
accatgggtgggtcacgtgggccgcgcctcggccaatgcggcggctgcgtagcgcccgggcccgcccctgagcc

SEQ ID NO: 24663 - DNA, 73 bp, Homo sapiens
cgccgcggagcccggcgggctcttcttggacaggtccaggccacaaagaggggagcagcggcgctccgaggca

SEQ ID NO: 24664 - DNA, 64 bp, Homo sapiens
tggtgacacagcgagactccgtctcaaaaaaaaaaaaagatggtgtcttgctctgtcaaccaga

SEQ ID NO: 24665 - DNA, 55 bp, Homo sapiens
ggacgcccgctcccgccaccatggttatcaagacggacgagttgccggcggccgc

SEQ ID NO: 24666 - DNA, 58 bp, Homo sapiens
tcctccgcgtccccgcccgccagctgctgtcggaggttgacaggtcgaggcggggagg

SEQ ID NO: 24667 - DNA, 77 bp, Homo sapiens
cgcttcccaagtcggcagtctcagcgcgcctgcgccgagcggccctgcgcgcagtgaggcagtggcgggggaaggca

SEQ ID NO: 24668 - DNA, 72 bp, Homo sapiens
tgctcctgtttggagctgctgctgcgcaggctgcgccggatgatgctcagcagcggctccagcagctccagg

SEQ ID NO: 24669 - DNA, 62 bp, Homo sapiens
gagtgagctgccgccctcccagccacatgccccgaggtggccccggggtgcagcctgctcag

SEQ ID NO: 24670 - DNA, 61 bp, Homo sapiens
gcgcggggtgcctgccaggggggaggctcctaaggcccaccccggtgttttccccgccagc

SEQ ID NO: 24671 - DNA, 77 bp, Homo sapiens
ataggatgcggcaggagggcagtggaggctgaggtacggatttctaggcccgccctaccctcctctctgcccctagt

SEQ ID NO: 24672 - DNA, 64 bp, Homo sapiens
gggggagtggcaggggtcctgggttctgttcacagaactccagggcaacccttcccttcccagg

SEQ ID NO: 24673 - DNA, 74 bp, Homo sapiens
cccgctgcccgcgggcccaggtcggcgtcggccgcgggcaagaaggctggtcggcgcgcgggcgggagggcgca

SEQ ID NO: 24674 - DNA, 73 bp, Homo sapiens
ccccggctccgcgcccgcccgcccgccccgccgttcagcccggacgccagcagccccggggagccaggcggcg

SEQ ID NO: 24675 - DNA, 58 bp, Homo sapiens
tcctgtgctgtgggccgaagctggccgcctgcggcatcgtcctcagcgcctggggagt

SEQ ID NO: 24676 - DNA, 61 bp, Homo sapiens
ggtggggctgtcggtctgaccgcgggtccatctgtcctgccgtcggcccacagcctcctcc

SEQ ID NO: 24677 - DNA, 62 bp, Homo sapiens
cccaggggagggaaggggagccgaggtcaacgctgcgcctcggtccctaaccccctccggac

SEQ ID NO: 24678 - DNA, 80 bp, Homo sapiens
ggaggggcagcggcggaggctgggaggcagcagctgcctgggacccgcacgtgcactcccacacgctcgcgcccaccccc

SEQ ID NO: 24679 - DNA, 83 bp, Homo sapiens
tgactcacgctcccccaccccaagcctgaatcagaccccgagggagggctttgtacggggggcgggggggcgagtgaggagtc

SEQ ID NO: 24680 - DNA, 55 bp, Homo sapiens
gagttagcggggagtgatatattattgctgcaagtacacttctccactttcaaag

SEQ ID NO: 24681 - DNA, 72 bp, Homo sapiens
gaacggggcctgagggagcggatggggcccagctattgcctgccccccacctttcccaaagcctccgtgccc

SEQ ID NO: 24682 - DNA, 55 bp, Homo sapiens
gggcccggggaggtggcgctggtcaggaagcctcgcccagccctcccggggccca

SEQ ID NO: 24683 - DNA, 66 bp, Homo sapiens
ggtggggaagttagggcaagaggcctgggaacctccaccccaagcctcttctcatctccccacaga

SEQ ID NO: 24684 - DNA, 61 bp, Homo sapiens
cgggggccccagccggggtagggccgagccctggctcccaggcctggctgggctccctgga

SEQ ID NO: 24685 - DNA, 71 bp, Homo sapiens
ctttccacagcttaccagtcggtgggattaccaattgatcaatcccaaagattgataagctgtggaaagca

SEQ ID NO: 24686 - DNA, 73 bp, Homo sapiens
ccccgaggcctccctccctcccatgtggtgaccccagcatgtagcctcagccctggggaggaggtccctggct

SEQ ID NO: 24687 - DNA, 70 bp, Homo sapiens
ggctgctccgcgcgcctgctcccggggctggcaggaggtccggggcccgaggtgcaggtgccgccatccc

SEQ ID NO: 24688 - DNA, 83 bp, Homo sapiens
tagaggcgtgagccagcgcacctggcctccagtattatttaagaggtagaaataggccgggcatggtggctcacgcctctaat

SEQ ID NO: 24689 - DNA, 67 bp, Homo sapiens
tggcctggcacatggccgctggcggcgcgtgacgggggcgtggcctggcggtctagggctgggggcg

SEQ ID NO: 24690 - DNA, 59 bp, Homo sapiens
ggcggggctgcgggaccgcgagtgagtgtggtcgctcctggttctgccagctcccctga

SEQ ID NO: 24691 - DNA, 79 bp, Homo sapiens
gcgggcacagagggcgcatgggcaggcctgggccaggggctgtgccctccttggctgcccctgtgccaagctgccccct

SEQ ID NO: 24692 - DNA, 60 bp, Homo sapiens
cccagcgttgcggccggcgcttgcgggttaccgggccaggcggcgcgcatctctgggcct

SEQ ID NO: 24693 - DNA, 64 bp, Homo sapiens
gggctgcactgccgaggcactgcacccgcctcacacacgtgcaatgcaacagcaatgcaccgcg

SEQ ID NO: 24694 - DNA, 59 bp, Homo sapiens
atctgctgtcttgcgcaaggccatcgactacattcgctttctgcaacacagcaaccaga

SEQ ID NO: 24695 - DNA, 61 bp, Homo sapiens
cgggcggcacccggcctgggacgcgtagaggcgcacgtgtcccggcccggagccgccaagg

SEQ ID NO: 24696 - DNA, 59 bp, Homo sapiens
gccgccgccgcccggagcggacgtttcacgagtcacgtcccggtgacggcgagcgtggg

SEQ ID NO: 24697 - DNA, 57 bp, Homo sapiens
accaaggggtggggtgtttgggggctgagtcagctgcgaacacccccacccctgcac

SEQ ID NO: 24698 - DNA, 60 bp, Homo sapiens
acgggaaagaataagaagccataagaaccaatagctatgacttcttattctttcctgtgt

SEQ ID NO: 24699 - DNA, 60 bp, Homo sapiens; identical to SEQ ID NO: 24698

SEQ ID NO: 24700 - DNA, 64 bp, Homo sapiens
cggctgaggcccgcaagcgcaaggtgcgcccggcagcccaccgcgcggcgggctcggggccttc

SEQ ID NO: 24701 - DNA, 52 bp, Homo sapiens
tcgggctctggccgggacaccatggggggcaaggcccggccgcgcgcggggg

SEQ ID NO: 24702 - DNA, 73 bp, Homo sapiens
agcctgggagacacactagcatgctttggtgggaccagcctttccagggcatgctggcttcccctggggctga

SEQ ID NO: 24703 - DNA, 59 bp, Homo sapiens
actctgagatttcacaggctgtgcttgtaagtgggcacagacctgccgtcttggagtcc

SEQ ID NO: 24704 - DNA, 58 bp, Homo sapiens
cgaggcgcgggctgtggggccgccgcgtgcctggccccgctcgcccgtgccggccgct

SEQ ID NO: 24705 - DNA, 58 bp, Homo sapiens; identical to SEQ ID NO: 24704

SEQ ID NO: 24706 - DNA, 71 bp, Homo sapiens
ttgggtctaggggtgggaactgggcactgcagtcagctctgaccctggccagttcccccatccctaccccc

SEQ ID NO: 24707 - DNA, 55 bp, Homo sapiens
tgtgggggaccctggctcttccccatctgatggagccgccacactccctcgcagg

SEQ ID NO: 24708 - DNA, 57 bp, Homo sapiens
ctggcctggagcagcccagagcaaggagactccgctctgatgctgctctggctccgt

SEQ ID NO: 24709 - DNA, 63 bp, Homo sapiens
gctgggcggcgggccgggcccggggccgcttggaatggcgcctcctccgccttcgccccaact

SEQ ID NO: 24710 - DNA, 53 bp, Homo sapiens
gcgcagcctgcgcctcgtgccggagcagagcagaggccaggatgcggagttgt

SEQ ID NO: 24711 - DNA, 53 bp, Homo sapiens
tgcgcgaggccgcgccgggccgcttggaggcgcccggtgcagtcgggaacccg

SEQ ID NO: 24712 - DNA, 54 bp, Homo sapiens
ccaatgctagacctggtggctagaccttgattgccaccgggtctagcattggga

SEQ ID NO: 24713 - DNA, 78 bp, Homo sapiens
acgctcattcatttatgtccacactccacagccatgtccacatttattgaaactgtggacgtaaatgaatgggcatgg

SEQ ID NO: 24714 - DNA, 59 bp, Homo sapiens
gcatatcattgttgtgtttgtaaaaaacaatggccaatagagataacagtttatgaaaa

SEQ ID NO: 24715 - DNA, 57 bp, Homo sapiens
gctcagaatcgcgactaaggctttttttttttctccctctgaacggttaggctatgg

SEQ ID NO: 24716 - DNA, 62 bp, Homo sapiens
tgggagggggggccgacttcctggggccgcccgtgaggatgtcgcgaccgcccccgggtgcc

SEQ ID NO: 24717 - DNA, 71 bp, Homo sapiens
cgggccgcgggcgggccgcgggcgggccctgggcagtcgtggcgcccctggcccggccttcgcggcccctt

SEQ ID NO: 24718 - DNA, 60 bp, Homo sapiens
cgaccggcggctctttggcgcggattagggggtctcggcgaggtgaggcgccaggcagcg

SEQ ID NO: 24719 - DNA, 90 bp, Homo sapiens
tggcgggccggcgggcgggcagcggcgggcctcgccgctctgtgggggagggcggtgtggggccgggcctgaccccgggggcccgccccg

SEQ ID NO: 24720 - DNA, 76 bp, Homo sapiens
cggggcggggggacgcgcggggcggcaggcggcgcgcgtgcgcgctgggcttctgcgccgtgcggtgtggtccggg

SEQ ID NO: 24721 - DNA, 82 bp, Homo sapiens
cccaggggtggcagaaggtggctcaagtcccctccttcaagcctggcaggaggtgggcaaactccttctcacccctgtggct

SEQ ID NO: 24722 - DNA, 60 bp, Homo sapiens
acccggggaggggggcgggcatcagatgcttccccagcccagctcttcctcctcgcccat

SEQ ID NO: 24723 - DNA, 78 bp, Homo sapiens
ccagccccacgcgtccccatgcagccctggcagtgcctccggcgctttgccctggcctggtgggagaggacggcggag

SEQ ID NO: 24724 - DNA, 59 bp, Homo sapiens
ggccggcggcgcgtggtgcccgggtgagcacccccgccctgcaccagcccccgtcccga

SEQ ID NO: 24725 - DNA, 70 bp, Homo sapiens
tgcagattcctaggccccacccaagggacttctgcttggcagctctgggtgaggcccaagaatctgcatt

SEQ ID NO: 24726 - DNA, 54 bp, Homo sapiens
cccccgcgggggcccgctggtgggaagagacggggggcgaaccggcgaggggac

SEQ ID NO: 24727 - DNA, 77 bp, Homo sapiens
agctgcacctgaggccgggggtcgggggtgcagggctggagccgggcaacccttcctttggccggggtcggggcgcg

SEQ ID NO: 24728 - DNA, 58 bp, Homo sapiens
gcgcaaggctgcctagtgcccctgtctggcctgggctctgggctgagccttgctgctt

SEQ ID NO: 24729 - DNA, 78 bp, Homo sapiens
tatgaggggcggaggagagggtggctggaggggtgcatggggctcctctcagaccccctcaccactgtcccttctctc

SEQ ID NO: 24730 - DNA, 60 bp, Homo sapiens
cgggagtgggggacggtgggacgccgggactaggccgtcgcgctgcacgccagtctcgcc

SEQ ID NO: 24731 - DNA, 50 bp, Homo sapiens
ctgtgacccgggcagtttcacttctggatcctgctcgggctgtgatagga

SEQ ID NO: 24732 - DNA, 56 bp, Homo sapiens
agtgagaggctgaaaggggtctgcggccccagctgacccccgtctttctctctagc

SEQ ID NO: 24733 - DNA, 62 bp, Homo sapiens
cgtggaggccgcggctgaggcccgccgccggcccatgggggcctcgccgccgcctctgctgc

SEQ ID NO: 24734 - DNA, 62 bp, Homo sapiens; identical to SEQ ID NO: 24733

SEQ ID NO: 24735 - DNA, 51 bp, Homo sapiens
ggcttcggccgccccaggctcgtcctcgggcccgcccagcgccgcagcccg

SEQ ID NO: 24736 - DNA, 62 bp, Homo sapiens
tggagccaggctgagaaggggtgccatggagaagaaggccctcactctccctcctcccccag

SEQ ID NO: 24737 - DNA, 88 bp, Homo sapiens
ccggcccggcggctggcgcaggttataaaggtcccgccgcagcagcggacggcagactcgagatgcgcccgaagaggttgggccggtg

SEQ ID NO: 24738 - DNA, 90 bp, Homo sapiens
agccggcgggagggggcccgccgcgtgctcagcacttaggtggttctgcagggctgggggcagcggcggagacccttcttgcctggtgac

SEQ ID NO: 24739 - DNA, 68 bp, Homo sapiens
gcgaggctgcgccccattggccaactgcaatgaggtcattgcgggggcgggggccggcggcggcgcag

SEQ ID NO: 24740 - DNA, 80 bp, Homo sapiens
cggggcatgggccgagctgaggccatggccgcctacctggccctggcggcgcagtgtccggggttcggcgctgctcggta

SEQ ID NO: 24741 - DNA, 61 bp, Homo sapiens
gggcgccgcctcgcgtcccggggtccggggaagatgggatctgggccggggcggcgcgctc

SEQ ID NO: 24742 - DNA, 80 bp, Homo sapiens
tccgtcccgtactcaccccgcccggggggccgcgccggggcccggcagcctctcagggccgcgtcctccggcggcggcga

SEQ ID NO: 24743 - DNA, 63 bp, Homo sapiens
agtgggaggggaggggagtcctgccaggagggccacctggtgactccacatcctttctcaccc

SEQ ID NO: 24744 - DNA, 80 bp, Homo sapiens
cgggggaagaggaagggcgggtaaagggcgcgcgcggccacggaagcgggcacgcgccccagtctcctcctcccgcctcc

SEQ ID NO: 24745 - DNA, 58 bp, Homo sapiens
ggcgcagcgctcaccggccccgccgccccctccggcggccggggagaactgcgcctgc

SEQ ID NO: 24746 - DNA, 58 bp, Homo sapiens; identical to SEQ ID NO: 24745

SEQ ID NO: 24747 - DNA, 65 bp, Homo sapiens
tcctcccttctccctcctcctccccgctccggcggctgaggctgcggcggcggcggggggtgtgc

SEQ ID NO: 24748 - DNA, 64 bp, Homo sapiens
ccgctccctcccacagcctgcccgggcgggctccgcggggggcagctgggaggaggggcgggag

SEQ ID NO: 24749 - DNA, 51 bp, Homo sapiens
tcttagaatccccaaaccacttcacagaatgctttggggattctaagagtt

SEQ ID NO: 24750 - DNA, 50 bp, Homo sapiens
ggcttccgctgcgcagccaggggtaccaagtgtttgcgcagggaggcccc

SEQ ID NO: 24751 - DNA, 72 bp, Homo sapiens
aggtgtgagccaccatgcccagcctataaaaaaattttttttaattagccaggcatggtgttgcacacccgc

SEQ ID NO: 24752 - DNA, 58 bp, Homo sapiens
gagggaagggggggtggggaggggccggctgtgcccccctcacctgcccctccccaca

SEQ ID NO: 24753 - DNA, 54 bp, Homo sapiens
cccgggcggcgaggggcggcccggctccgccctgcgcccctaaccgcccgggta

SEQ ID NO: 24754 - DNA, 70 bp, Homo sapiens
agctggtcgtggtggcctcggcctcccaaagtgttgggattacaggcgtgagcctctgctcccggcctaa

SEQ ID NO: 24755 - DNA, 62 bp, Homo sapiens
ggaggaagtggctggccttgcttccggttccctgctgatcagcctccttccctgtcctccct

SEQ ID NO: 24756 - DNA, 61 bp, Homo sapiens
cctgagccaccatgctgagcctaaaaaacttattttaggccttgcgcggtggctcacacct

SEQ ID NO: 24757 - DNA, 61 bp, Homo sapiens; identical to SEQ ID NO: 24756

SEQ ID NO: 24758 - DNA, 66 bp, Homo sapiens
ggtcttgaagcctgggcctccactccgcctactgcaatggtggaagctccagtttacaagacaccc

SEQ ID NO: 24759 - DNA, 72 bp, Homo sapiens
cggctgggtggggaccaccatgggcaacgcggccggcagcgccgagcagcccgcgggccccgccgcgccgcc

SEQ ID NO: 24760 - DNA, 61 bp, Homo sapiens
acagaaggcggaggcgactagggtgttggtggaaccacacatgcgccctcggcttctggca

SEQ ID NO: 24761 - DNA, 61 bp, Homo sapiens
cgggggcagagagcctggggcgccggggctgggcgcagcgaggcgcggctggactccgggc

SEQ ID NO: 24762 - DNA, 75 bp, Homo sapiens
cgcgccggggtggagcggcccttcgccgccgcagccgcagccggcggaggcgctgctgtccctcctccccgtgtc

SEQ ID NO: 24763 - DNA, 66 bp, Homo sapiens
agtgggatttccgagtagcatcccttgagtgcagattccaaggatgctactcagaaatcccactga

SEQ ID NO: 24764 - DNA, 64 bp, Homo sapiens
gggaagcagcagcgtagggccactccgcggcctggtgcggcctaggcccggctgcttctcccgc

SEQ ID NO: 24765 - DNA, 64 bp, Homo sapiens
ccgccgcccgcggccgcttttcccgcagcgggaggggaggggaggggacgcggtgggtgggacg

SEQ ID NO: 24766 - DNA, 62 bp, Homo sapiens
accctttctcttgcctttctcagaaggcagaggtattcagaaaagggcaagagagagggcaa

SEQ ID NO: 24767 - DNA, 88 bp, Homo sapiens
ccgggggtagggctgaggtgattggggtgggggaggggaggcccggcccctctgaccccgctccgtctcccactttcctccccctaga

SEQ ID NO: 24768 - DNA, 61 bp, Homo sapiens
ggggcgggggagtcgggcctaggggccatgtggaagctccgggcccggccgcccgccctgt

SEQ ID NO: 24769 - DNA, 69 bp, Homo sapiens
cagagagcgcgggtgagtcacgggcggagctggccttgttcgctcgctggctcctgcccgccctccgtc

SEQ ID NO: 24770 - DNA, 61 bp, Homo sapiens
cgggcactgggtcttctccacgcagattgagacgtctgctggcggggtcctagcgccgatc

SEQ ID NO: 24771 - DNA, 70 bp, Homo sapiens; identical to SEQ ID NO: 17746

SEQ ID NO: 24772 - DNA, 63 bp, Homo sapiens
gcgactgcctccctgctgtgagcaggagaacaggaagtctgcccgacagggaggtggccgggc

SEQ ID NO: 24773 - DNA, 63 bp, Homo sapiens; identical to SEQ ID NO: 24772

SEQ ID NO: 24774 - DNA, 59 bp, Homo sapiens
gcggaggaagaggggacgaggagccgggccccacctccttctcctcctctccctcccta

SEQ ID NO: 24775 - DNA, 57 bp, Homo sapiens
cggggccgggggcccggggagcggcctggctccgctgcccgggctcccgccctcagc

SEQ ID NO: 24776 - DNA, 61 bp, Homo sapiens
cagggaggtggagtggaggagggaggtgtctgagaggccccccaccctccatctccctcag

SEQ ID NO: 24777 - DNA, 70 bp, Homo sapiens
gggggcggctcagccccgcgcccgtgcgcgcgctcgcggccgggttgcagggctgggcgcgcgccccgcg

SEQ ID NO: 24778 - DNA, 72 bp, Homo sapiens
cccatctcagtggtcgcggaaggtgacgtggacacggaagtggtcgtcgtcgcggcaccggtgggagctagg

SEQ ID NO: 24779 - DNA, 50 bp, Homo sapiens
gggttcgaggggccggtggccgcgaggctgaaaatggtgccgaggaaccg

SEQ ID NO: 24780 - DNA, 71 bp, Homo sapiens
agaaggagcgaagctctggcccggcgtgtagcgggcgcactacggggacgctgggccgggcaccgggctgt

SEQ ID NO: 24781 - DNA, 69 bp, Homo sapiens
aggcccaagctcatatccctgcattaggatggagccagggtgcagggggtatgggcaagggtcccctgt

SEQ ID NO: 24782 - DNA, 69 bp, Homo sapiens
tgaacccgggaggcggaggttgcagtgagccgagatcgtgccattgcacttcagcctgggtgataaggg

SEQ ID NO: 24783 - DNA, 66 bp, Homo sapiens
cccgcctccagctcgcggccccgcgcgccggatcggcgtgcgtgcggctggagccttaagcgtttc

SEQ ID NO: 24784 - DNA, 65 bp, Homo sapiens
atagcctctcttccctggattgtgacatatggaatgacagtgcaggtaccaccgaggctagcaca

SEQ ID NO: 24785 - DNA, 62 bp, Homo sapiens
ccgcgggggggctggggtggggcccggggcggggatggggcgcggcgtccccccccgcgggg

SEQ ID NO: 24786 - DNA, 55 bp, Homo sapiens
ggttcacttgggtctagaattacctaaaaggcaattccagacccaagtgaaccta

SEQ ID NO: 24787 - DNA, 93 bp, Homo sapiens
cggacccggagggatgcggagtggcggccgcggcggtggcggagactgtggctttaagagcgtgccgggagcccgagccccagccgggccgcg

SEQ ID NO: 24788 - DNA, 72 bp, Homo sapiens
ctcgcggagggagcccaagggcgcgggacccccggccggggcgggagacgcgcgccaggggctgggcgagtc

SEQ ID NO: 24789 - DNA, 72 bp, Homo sapiens
tctgtttcctcatttatctgttgggaagctaactgtgaccttagcgtcccagcagataaatgaggaaacaga

SEQ ID NO: 24790 - DNA, 51 bp, Homo sapiens
agatccacatctggcctgtgttgcttatgaacgtggccaatgtgatctgga

SEQ ID NO: 24791 - DNA, 68 bp, Homo sapiens
cgttcggcgggtggggtccgagcagctgacggttagtgtggcagttgccgggacctaacatggaagac

SEQ ID NO: 24792 - DNA, 99 bp, Homo sapiens
ggcggcgctagcgagcggccggcggggcgcgggttgctgggcgcgctgctccggcggggcccgctggcacagccgcctcgcgcgagccgcccgcccggc

SEQ ID NO: 24793 - DNA, 99 bp, Homo sapiens; identical to SEQ ID NO: 24792

SEQ ID NO: 24794 - DNA, 59 bp, Homo sapiens
aggtcggggccggcggggccgcgatgagaagccgctgccccgacctgaccccggccctc

SEQ ID NO: 24795 - DNA, 85 bp, Homo sapiens
gtgcagcgataaggcggtggcggcggcggtggctcggggaccactggtagcggcagcagctcgcgcccgcgccctcctcgtaccc

SEQ ID NO: 24796 - DNA, 61 bp, Homo sapiens
tgctgctggggctggcactcaggaagatgccaagcggaatgctgagcctggccttggcacc

SEQ ID NO: 24797 - DNA, 73 bp, Homo sapiens
cctgcaggttccgggaggtcaggttgtattcctggcgggtcgtctggctgggtgggccccggaggtcgtggct

SEQ ID NO: 24798 - DNA, 58 bp, Homo sapiens
ctgtcggccgcctggacttcccgcgcgctgcgccatgggcccggagcggccgcaaggg

SEQ ID NO: 24799 - DNA, 62 bp, Homo sapiens
gtgacgaatgcaaccagcgtggccccaaatgagtcggcggccgccgcaggttgacgtagagc

SEQ ID NO: 24800 - DNA, 62 bp, Homo sapiens
atgcttgtgttcaggtggatgattacatgtgtatgtgtgtacatccataaacacaatcttca

SEQ ID NO: 24801 - DNA, 60 bp, Homo sapiens
cccgccctatcaggtgctctggtcctcgggaccagctggaggggcgagaaggggcggggc

SEQ ID NO: 24802 - DNA, 55 bp, Homo sapiens
ccaaccccccacctcaagtctgtatttctcccagacttgaggtggggggttgggg

SEQ ID NO: 24803 - DNA, 51 bp, Homo sapiens
cggctccgggacccgcaaagtttgctagccggctgggcgcggagccgaggg

SEQ ID NO: 24804 - DNA, 88 bp, Homo sapiens
cccgccctcagagctgggcctcgcagccgctagggattgcgggggccgcatttatccctgtgtctctcaggccccgcagagacggggg

SEQ ID NO: 24805 - DNA, 62 bp, Homo sapiens
tcaggggatgggagtgacatggcctggggatgcccagggctctgaccactgcatccccttcc

SEQ ID NO: 24806 - DNA, 57 bp, Homo sapiens
cagactgggcctgggctggggtgggtgacgcctggcaccaggtcatcctggtttgct

SEQ ID NO: 24807 - DNA, 87 bp, Homo sapiens
gactctgggacgctcagacgccgcgcggggcggggattggtctgtggtcctctctcggctcctcgcggctcgcggcggccgacggtt

SEQ ID NO: 24808 - DNA, 67 bp, Homo sapiens
ccctgcggagcagtagctaggaacagatccacttgcaggttgctgttcccagccatggcttcgcgct

SEQ ID NO: 24809 - DNA, 59 bp, Homo sapiens
gtggggcttggggcattggatccgatccctggagggctcctctgctctgccctctccaa

SEQ ID NO: 24810 - DNA, 60 bp, Homo sapiens
gttctgggctgccccggggcctggggtgatgacccgcaagcccaagggcgctcggactcc

SEQ ID NO: 24811 - DNA, 67 bp, Homo sapiens
agggcagtccttgtggggtcctcgtggccagccaagatggctgcccccgcagtgaaggttgcccgag

SEQ ID NO: 24812 - DNA, 92 bp, Homo sapiens
atccggtccgtacaaactctgcagtgattcaatcaatgagcaaacaaactcaccaatcattcaacacagcagagtttgtacggaccggattc

SEQ ID NO: 24813 - DNA, 57 bp, Homo sapiens
gtgcccagtcctgtgggagatacagctgaagtgtgtgtgtcccccaccctgagcagc

SEQ ID NO: 24814 - DNA, 65 bp, Homo sapiens
gggcgaggcgggccgcggggtctccggaatggactgacgcagacccctccccactcctcgccagg

SEQ ID NO: 24815 - DNA, 67 bp, Homo sapiens
cggctccggctgctgacttcctgaggccccagcaacctggggctggctgaggtctggtggggcccct

SEQ ID NO: 24816 - DNA, 67 bp, Homo sapiens
cgggtctccctcctgctgcaggcgggtctccaaggagagtcggggtagcagcacggcggcgccaagc

SEQ ID NO: 24817 - DNA, 65 bp, Homo sapiens
tgggcaggcaggacagggaggcacaggcagacttgctgctccaggccctcgcctgcttgcccaca

SEQ ID NO: 24818 - DNA, 50 bp, Homo sapiens
ccgggtcctagtggcggccgcagtgtcgcaggccggagggaagatggcgg

SEQ ID NO: 24819 - DNA, 71 bp, Homo sapiens
gccctcctccaacccctggacgctgcgtcctgatttccccagggacgcaggcctggttgggagaaggggtg

SEQ ID NO: 24820 - DNA, 54 bp, Homo sapiens
ccggtcccggggccgcggtagctcagagaagcgccgtcgggcgggggggcggca

SEQ ID NO: 24821 - DNA, 71 bp, Homo sapiens
agcggcggcagcagcggtgagcgcgagccccggagccccgggcggccggcctcccgcgcccgcgcagcccc

SEQ ID NO: 24822 - DNA, 65 bp, Homo sapiens
tgaacccgagaggaagagattgctgtgagccaatctcattgcaccctccacctcccaggttcaag

SEQ ID NO: 24823 - DNA, 76 bp, Homo sapiens
cacgcctgctttctaagcagctctggctgactggccacaggccccagccatgagactgagaggagaaagggagtga

SEQ ID NO: 24824 - DNA, 50 bp, Homo sapiens
tggggacccagctgctgaagttatcattaaacttgagcagtccaggggcc

SEQ ID NO: 24825 - DNA, 56 bp, Homo sapiens
gggtggggattagggtccctggctgcagaacagccaggccccaagtccccactcca

SEQ ID NO: 24826 - DNA, 54 bp, Homo sapiens
gggagtgggggaaggaggcccctgggcagctcggtgcctctctccccactctgc

SEQ ID NO: 24827 - DNA, 72 bp, Homo sapiens
acagtagtctgcagtggtgtgcagtagtctgcagtggtgtatactagtctacagtagtctgcagtggtgtat

SEQ ID NO: 24828 - DNA, 67 bp, Homo sapiens
cgtgtggggactggccgctcccgggctgtggccctgggccctgcccgacagcccctctcccgcaggg

SEQ ID NO: 24829 - DNA, 55 bp, Homo sapiens
tgcacaggcctggagctcctcacaggcgcggtgaggaagccctaggactggggga

SEQ ID NO: 24830 - DNA, 71 bp, Homo sapiens
cggggcggagtgctggggcgctgggtgcccgagtccccgggttccctgagcttagaagggcctgtctggag

SEQ ID NO: 24831 - DNA, 50 bp, Homo sapiens
tgggcagggcgggtgactcaggggcgcccctgtcaccacccccgtccagg

SEQ ID NO: 24832 - DNA, 63 bp, Homo sapiens
agagttgctgccgctgctgtcctcacacccgctcgtgggaagcagcgcctgtcgcaactcgcc

SEQ ID NO: 24833 - DNA, 63 bp, Homo sapiens; identical to SEQ ID NO: 24832

SEQ ID NO: 24834 - DNA, 71 bp, Homo sapiens
ggggcggggcgcggcggccgcctatatacccgcgagcgcggcctccgcggcggctccgacttggactccct

SEQ ID NO: 24835 - DNA, 77 bp, Homo sapiens
tgttctgcttggagatcttacaccagaagttgttgggtgacaacaaatgctggtgtaagatctccaagtggaacaga

SEQ ID NO: 24836 - DNA, 69 bp, Homo sapiens
ccggaccggcggctaccgggcccagactcccgcgggcagggccgtcccggagcccgcgcctcgccggcg

SEQ ID NO: 24837 - DNA, 60 bp, Homo sapiens
agggagctctctgtgtgggctctgctgcgctgggagcctgtcacggtaggagctctcccg

SEQ ID NO: 24838 - DNA, 57 bp, Homo sapiens
aggcccggctggatgggcaggcagcccatctgtgcctccccatccagccgggtctca

SEQ ID NO: 24839 - DNA, 60 bp, Homo sapiens
gggcgagcgcgcgcggggcggaagtcggccaccttcctccgtcccggccgttagcccagc

SEQ ID NO: 24840 - DNA, 74 bp, Homo sapiens
gggaggaagaagggaggaggagcggaggggcccttgtcttcccagagcctctcccttcctcccctccccctccc

SEQ ID NO: 24841 - DNA, 91 bp, Homo sapiens
tggagggaggagggggtggggaagtcggtggcaggcactggggaagccgagccgccgagcccgagcccggcgccctgtgttgtgctccgct

SEQ ID NO: 24842 - DNA, 93 bp, Homo sapiens
tctgcagccgcgccggccgccagcgccccggcgcgctccggctcggccatggagctgccagctgttggcgagcacgtcttcgcggtggagagc

SEQ ID NO: 24843 - DNA, 66 bp, Homo sapiens
gccgcaggtgcgagcgggcctggagagtctcccggggcggggagcgggctaggatacagtgggccc

SEQ ID NO: 24844 - DNA, 65 bp, Homo sapiens
tcctgctcatatcctggactgtctttcagggatttactaccggcttccgggacttgagcaagtct

SEQ ID NO: 24845 - DNA, 56 bp, Homo sapiens
gctcggggcttggccgtagcttttcctcaggtcccgcgcggcgcgcccctgtgtcg

SEQ ID NO: 24846 - DNA, 61 bp, Homo sapiens
tgtggaccgcgcggccgaagagcgcggcgcccagagcgcgggccgctcgcggagccacagc

SEQ ID NO: 24847 - DNA, 55 bp, Homo sapiens
acaggcatctcatgcggctgaagcgcaaggagagaagccggggggatgtctgagc

SEQ ID NO: 24848 - DNA, 62 bp, Homo sapiens
ccgcttcgcaggtaagcccgccgggcgggcggcgaccccccggccggcccctcggggcagag

SEQ ID NO: 24849 - DNA, 61 bp, Homo sapiens
cgggggaggcccgtggggtctgctttggactggggcagccctcagcgtggccgcccgcaga

SEQ ID NO: 24850 - DNA, 58 bp, Homo sapiens
ctggcccattctccccgagggccaggccgggtgaggtcagcgggaggaagggtcagtg

SEQ ID NO: 24851 - DNA, 78 bp, Homo sapiens
ccctagctggctctgcggctcttccgggtctgggctcggagattcacaggcggcccgcgaggccgagcgagggacgca

SEQ ID NO: 24852 - DNA, 75 bp, Homo sapiens
cccccccagccccgtccgcctgacccggcccaccccgccttttgttcccggggaaggcgcgacgaggcctcggca

SEQ ID NO: 24853 - DNA, 64 bp, Homo sapiens
tgggggcaccactgtggcttgtgaaagagcagacacagggatgagccgcactggtgtccccaca

SEQ ID NO: 24854 - DNA, 62 bp, Homo sapiens
actgggctggttttgtccttgaagtggtcaggatacaggacaagggcagccccaccccatcc

SEQ ID NO: 24855 - DNA, 62 bp, Homo sapiens; identical to SEQ ID NO: 24854

SEQ ID NO: 24856 - DNA, 59 bp, Homo sapiens
cccgtgcggggttggggctcgtggcggaagctccggacctccctggcccgaacggtgag

SEQ ID NO: 24857 - DNA, 64 bp, Homo sapiens
ccccacccatgccgctcgcgcccttcaggcccggcttgcgtgggccgcagtggcagcaggggag

SEQ ID NO: 24858 - DNA, 78 bp, Homo sapiens
gggggggcagcgcggccgggcggccccggcggctccattcaccgcggccagcccggcgccgccgcccccccccgcggg

SEQ ID NO: 24859 - DNA, 50 bp, Homo sapiens
cgcgccagacccggaaagcgcggtcgtcctctgcctccgggaagcgcggc

SEQ ID NO: 24860 - DNA, 68 bp, Homo sapiens
ccgggcagcctggctcccccggagggtggcggacatgtgtggctcacctcctccaggcgggcctggct

SEQ ID NO: 24861 - DNA, 57 bp, Homo sapiens
gtgagcagggctggggtacctcccccaacctaggacaccccacttgccctgctgacc

SEQ ID NO: 24862 - DNA, 53 bp, Homo sapiens
tgcctactggaggggacagtgcatcaaagaagcccatctcccgccgggcgcca

SEQ ID NO: 24863 - DNA, 82 bp, Homo sapiens
cccaggcgcgttcccgcgcagggtcccggctcgggcggcggcgcgcacgagcatcaccccaccggcggcggcgcgccgggtc

SEQ ID NO: 24864 - DNA, 77 bp, Homo sapiens
cgctcgggtcccgccgacaggaaacggggtccctggcgctaggttccggcccctcccgccccgccgggttccgcgct

SEQ ID NO: 24865 - DNA, 69 bp, Homo sapiens
aaccgagaggtggttactgtagtgtttgttgccttgctgcctttgcactcagtccattttctcagcact

SEQ ID NO: 24866 - DNA, 62 bp, Homo sapiens
ggcggcggcggctcgggctggggggtcaggtggacgccgccctccggggctggacgcgcatc

SEQ ID NO: 24867 - DNA, 59 bp, Homo sapiens
agcccctgcagcagctgggaaagcagtgtcagccacccctcaggtgctgtgggggtaca

SEQ ID NO: 24868 - DNA, 74 bp, Homo sapiens
agccggcacagcgacgccaagagcctccttggtgaggacactcggaccctggcccttgggatgctggccgctga

SEQ ID NO: 24869 - DNA, 53 bp, Homo sapiens
gggcgggcccggcgtgccggctcggtggcgcggccgcgcgtgctcccgcccct

SEQ ID NO: 24870 - DNA, 73 bp, Homo sapiens
gcaggcccatggcggcggccgcggcggcgctctcgggcgcgggcacgccacccgcgggcggcggggccggggg

SEQ ID NO: 24871 - DNA, 75 bp, Homo sapiens; identical to SEQ ID NO: 19677

SEQ ID NO: 24872 - DNA, 62 bp, Homo sapiens
ccgggccgccgcctctgcgctcagccccgcaggccgggcatgggtgggggcgccgggccgtc

SEQ ID NO: 24873 - DNA, 57 bp, Homo sapiens
tggggccccgtcaccgtcgaggctgcctggcttggtctcagggtggctgggcccatc

SEQ ID NO: 24874 - DNA, 66 bp, Homo sapiens
ttctggaaagtgcgctgagctgagagctcgcttctcttcctgctcaacgtgcactgggccgggtgt

SEQ ID NO: 24875 - DNA, 78 bp, Homo sapiens
cggcggcgggggcgggcccggggcggggggtcgcggccacggctgccccgcgcgcccccaggccgcccgcgccgcgcc

SEQ ID NO: 24876 - DNA, 71 bp, Homo sapiens
agcgagccggggctgaatcactccgcgggggcaggggcggccccagaagagccgtcggcctcggaggctcc

SEQ ID NO: 24877 - DNA, 63 bp, Homo sapiens
caggggccccacgggggacgccagggaacgtgaggaatccggagtcaacactgggccactgtg

SEQ ID NO: 24878 - DNA, 75 bp, Homo sapiens
agccagggtcaggacagactgtgagggggcctcttgttgggacagcgtcccctcggagcaagagcccggggcgtg

SEQ ID NO: 24879 - DNA, 62 bp, Homo sapiens
acgaggaggtggaggagggagagggcccgcgggcctcgcctccgccctccgccacctcgagc

SEQ ID NO: 24880 - DNA, 58 bp, Homo sapiens
gcggcggcgctggtcgcgggtcgcaccgtgaggctcgcgtgggcggcgataggcgctg

SEQ ID NO: 24881 - DNA, 87 bp, Homo sapiens
cgcaccgggcgcagcagctgattcatctgcagccaggtccgggaaggaactgtgctcccggcagttgcagggcagcgtccgggcggg

SEQ ID NO: 24882 - DNA, 80 bp, Homo sapiens
agtgaatccctagtggtcagagggcttatgatatattgtgagagccatgtcataagccttttggccactagggattcaat

SEQ ID NO: 24883 - DNA, 62 bp, Homo sapiens
tagtggccaaaaggcttatgacatggctctcacaatatatcataagccctctgaccactagg

SEQ ID NO: 24884 - DNA, 76 bp, Homo sapiens
gggatccgcccccgcgccgacacgcacttccggcagcgccgcggccgggagggaccgagcggggagcaaggcctgc

SEQ ID NO: 24885 - DNA, 60 bp, Homo sapiens
catggccgcccccgctcgcaccgccgcagtgcaccgcggtgggggtggggacggcccgaa

SEQ ID NO: 24886 - DNA, 61 bp, Homo sapiens
tctgcgagcgcgcgcgcggggccgccgccgcctggccgctccccgagcccgctcgccggcc

SEQ ID NO: 24887 - DNA, 81 bp, Homo sapiens
tgcgcggagggcgaaagtggccggggcgcccgctccgagacgcggcagagccccgcagcctcagcgcccggcctgcgcgcg

SEQ ID NO: 24888 - DNA, 63 bp, Homo sapiens
gccgcctcccctcacgcctcctcctccccgaggaatcggcgcttccgaagggacgggcggcgg

SEQ ID NO: 24889 - DNA, 73 bp, Homo sapiens
gcgggccggcggtgggcggggagcgggacgcgggagccgggcgcgcgccgccagcgccgccgcggcaccggtg

SEQ ID NO: 24890 - DNA, 80 bp, Homo sapiens
gggcagcaatggaaaactaatacactggtagaaactaagtgtttaagaaaccaatgtattggttttctattgctgcccta

SEQ ID NO: 24891 - DNA, 57 bp, Homo sapiens
ccgagggcccgggcctgccgcgggcggcgcggctcccggccgcccgggcccccggcc

SEQ ID NO: 24892 - DNA, 72 bp, Homo sapiens
ggtccgtctctcactggcgcggccttagcacccggggggggcgggagggagggctcagggctgaggggcctc

SEQ ID NO: 24893 - DNA, 55 bp, Homo sapiens
ccgagcccggctggagcggtccaggaaaggccggacctcacagcgggcctcgcgg

SEQ ID NO: 24894 - DNA, 53 bp, Homo sapiens
cgcagcgccagcgctctccccggatcgtgcggggcctgagcctctccgccggc

SEQ ID NO: 24895 - DNA, 87 bp, Homo sapiens
tgcggtgacatcagggcccagtccctgctgtcatgccccaggtgacgtgctgggctgacagcagggctggccgctaacgtcactgtc

SEQ ID NO: 24896 - DNA, 61 bp, Homo sapiens
gcgagcccgggtgggagaagcagctcgaagagctgctccagctcgcgccccagggccgtgc

SEQ ID NO: 24897 - DNA, 73 bp, Homo sapiens
ccggacggaggcggagctctggctgcttctgatcgctgtcccggcagatgccccagctctgtttcctctgggt

SEQ ID NO: 24898 - DNA, 85 bp, Homo sapiens
acctactcagagtacatacttctttatgtacccatatgaacatacaatgctatggaatgtaaagaagtatgtatttttggtaggc

SEQ ID NO: 24899 - DNA, 62 bp, Homo sapiens
acaacatgtttttgaggaccacttttgaaaggatttaggtagtccttaaaaacatgttgtgc

SEQ ID NO: 24900 - DNA, 66 bp, Homo sapiens
agccttctgttatgagttactgtagttatctagagagatttccagtaactcataacaggagactac

SEQ ID NO: 24901 - DNA, 59 bp, Homo sapiens
gagcgcgggagctggagcgctgtcagccgcgctgagcctgcgcctggcgaccgcgatgc

SEQ ID NO: 24902 - DNA, 60 bp, Homo sapiens
ccgccggaccgagactcgcgcggcgtgcgctgcccccgcgggtttcgttttcggcaccta

SEQ ID NO: 24903 - DNA, 58 bp, Homo sapiens
agttcaccccactgatgagtcttccttccctgttggactcagtcatttggggaacagt

SEQ ID NO: 24904 - DNA, 57 bp, Homo sapiens
tatctgggaggggaaaatttatcagctcaatagtatcccattgccagggattaattt

SEQ ID NO: 24905 - DNA, 65 bp, Homo sapiens
ttcccctaccctcccgcgcgcccgggccgccggccgggcccgggcctgggggcggggcgggaaga

SEQ ID NO: 24906 - DNA, 62 bp, Homo sapiens
ggggggcgagcggggcgcggggagtcgccggccaccgcctccccacctccctttgcctacgg

SEQ ID NO: 24907 - DNA, 84 bp, Homo sapiens
ggggcgggacgcccgcggtttcgcttgagttgggcgccggcgcgctcccaccggggctcacgggcggagagggagaggcccgcg

SEQ ID NO: 24908 - DNA, 61 bp, Homo sapiens
tctcccctccatcggtaccccctctacagacccgggagggggtggcggtggcggggggttg

SEQ ID NO: 24909 - DNA, 81 bp, Homo sapiens
cggagctcctctctgagcgccccgcccccggcccggaggcccaggtggcagcgggggcgcgggagggcgcgtcgggccggg

SEQ ID NO: 24910 - DNA, 88 bp, Homo sapiens
gcgggcctgcgcctccctcggctcctggcgcgggcctcggggagagggtgagtgcggtagggcataccagaggggggcgggcgcgctt

SEQ ID NO: 24911 - DNA, 67 bp, Homo sapiens
cgggccatcagcagtccaatgaagacattgggtcttcatgtcttcattggactgctgatggcctgtc

SEQ ID NO: 24912 - DNA, 50 bp, Homo sapiens
gacgcgggacgcgggcggggaagtaccccgctgagcgcgacctgcccgga

SEQ ID NO: 24913 - DNA, 69 bp, Homo sapiens
gccacacatgcagggctacacacagagcagaggctactggtgtgtgtgtgtgtgtgtgtttatggtagt

SEQ ID NO: 24914 - DNA, 57 bp, Homo sapiens
gcagaatgcagttgagaagacgttaaagatgctttagaaactaactgctcccttgtc

SEQ ID NO: 24915 - DNA, 60 bp, Homo sapiens
gcccggcggcggaggcgctcccacccgcgcggagagggatggagcgcgtcttgcgagcgt

SEQ ID NO: 24916 - DNA, 59 bp, Homo sapiens
aacgctgcgacctagatgtattcttggagtcacccagaaaaccatctggacgcagggac

SEQ ID NO: 24917 - DNA, 59 bp, Homo sapiens; identical to SEQ ID NO: 24916

SEQ ID NO: 24918 - DNA, 53 bp, Homo sapiens
ggctcttggccaccaaacaatctgaacaacaattgtggtgtccctagctaggt

SEQ ID NO: 24919 - DNA, 80 bp, Homo sapiens
ccgccccgccgctcccggcgccccccgcgccgcatccggggactggcagggcgcgggccccgcaccggccgccggcgggg

SEQ ID NO: 24920 - DNA, 71 bp, Homo sapiens
agctccggcgtgggcggggcccggcattgtgacgtcacggggcggggtttcccggcgcctgagcggactga

SEQ ID NO: 24921 - DNA, 53 bp, Homo sapiens
tgctggggctgggcagccggggacagagatggctcctgacccctccccgcagg

SEQ ID NO: 24922 - DNA, 52 bp, Homo sapiens
gcttgatgaagggtccttgggctgatgcaggccaagaactcatcacagatga

SEQ ID NO: 24923 - DNA, 62 bp, Homo sapiens
ggccgctctagcccgcggtcctccgagttcgtggcgggctgatgcgggcttggggcgggcgg

SEQ ID NO: 24924 - DNA, 73 bp, Homo sapiens
cgcagaggaggaggcaggcggcggccccggtggctcccccccggacggtgcgcggcccggcccgtctcgcgaa

SEQ ID NO: 24925 - DNA, 71 bp, Homo sapiens
ggtccgcgcctccgccgctttttatagcggccgcgggcggcggcggcagcggttggaggttgtaggaccgg

SEQ ID NO: 24926 - DNA, 89 bp, Homo sapiens
gggggtcctgggggccggggtgggcaggggtgacttggagagagtgacttgcgggggacaccctctcacccggcccctcgtgccccagg

SEQ ID NO: 24927 - DNA, 66 bp, Homo sapiens
gtggagggggctgagcgcagggccaggatgctggtcactgggtggccctgtgagctcccctccctt

SEQ ID NO: 24928 - DNA, 57 bp, Homo sapiens
agcgggctcagggatcgggcccgggcctcactgccccccatccgctgtccccgcagg

SEQ ID NO: 24929 - DNA, 70 bp, Homo sapiens
aggggagggagcgcctggcgcatgggggcacagggtagccggcactgctgacctgcactctctccccagg

SEQ ID NO: 24930 - DNA, 73 bp, Homo sapiens
cccgccgagtacgcagctttcgccgctcccgcgcccccgctccgccccgcgtgccgtgcgtgccgtgcgtgag

SEQ ID NO: 24931 - DNA, 63 bp, Homo sapiens
cgcccagacctaggcccttctcaggggtgccccggggcggggcgcgcggggcggggggcggcg

SEQ ID NO: 24932 - DNA, 59 bp, Homo sapiens
tctcccgccgtggggctgtgatcaggctcagcttggtcagcagcggcctggtggggatt

SEQ ID NO: 24933 - DNA, 61 bp, Homo sapiens
gcggctttgctgggcgggcttcccttgggagaggtgggagccccctccagaaaggccgtgt

SEQ ID NO: 24934 - DNA, 60 bp, Homo sapiens
ccacacccggggccagaccctcggggccatgccttggtggggcctgtgtcgggcgtgggg

SEQ ID NO: 24935 - DNA, 55 bp, Homo sapiens
cggcgggcaggtgggcagggcctcgcagtccagcttccccaccttgtctgcctcc

SEQ ID NO: 24936 - DNA, 77 bp, Homo sapiens
ggtgggcgtggtctggcaggtgggcagggccaggacgagcaccccaagactgccccttgttcccccactcctgcaga

SEQ ID NO: 24937 - DNA, 66 bp, Homo sapiens
ccggcgcagggcggggcgggcgtcctccaggccctcaccgggcgcccgccgccctgtgcccgcagt

SEQ ID NO: 24938 - DNA, 66 bp, Homo sapiens
cccgggagggcgggctgggcgggggtgtcaccggggtacccactcacggcccgtctcgccccagcc

SEQ ID NO: 24939 - DNA, 62 bp, Homo sapiens
acagcgaggaggcgggagtgggccgaggctgatgggcctccccacccccgggctcccgcagg

SEQ ID NO: 24940 - DNA, 51 bp, Homo sapiens
gctctgtggggctctggccgcgcctggcctggccgggaccatggtgagcta

SEQ ID NO: 24941 - DNA, 57 bp, Homo sapiens
taaactacactcagctcgtcgacctgcacgcccgatacgctgagtgtggtttgcgga

SEQ ID NO: 24942 - DNA, 70 bp, Homo sapiens
agtggggttctgggggggggggtgcaggcagaaggccgccatgcctccctccccctttccaccccagtga

SEQ ID NO: 24943 - DNA, 63 bp, Homo sapiens
cggccaccccttgctggggcgggtggcagcctgcgtcccccaccctggcagcgggcggattgc

SEQ ID NO: 24944 - DNA, 67 bp, Homo sapiens
gagggaggcagggaggagggcagggtgaagcccccaccctgcggcccagcctgcccggccccctacc

SEQ ID NO: 24945 - DNA, 58 bp, Homo sapiens
tggcgcccccggtctccagggccgctttcccggccttggggctggaggtatccacaca

SEQ ID NO: 24946 - DNA, 81 bp, Homo sapiens
cgtgggcggtgctgtgcggggtcgtcacgtggtgtgggcggtgcaggggccacgggactcacccgctctccagcctgcgcc

SEQ ID NO: 24947 - DNA, 57 bp, Homo sapiens
ggggccgcggagtggggccagggccggtgctggccactgacccaccccggtcactga

SEQ ID NO: 24948 - DNA, 50 bp, Homo sapiens
gtgctgggattacaagtgtgagccaccgcgcccagcctcatctcagcact

SEQ ID NO: 24949 - DNA, 69 bp, Homo sapiens
aggggctccttcagcacacagcagcgcgttccagttcacggaccgctcctgtgttctgtggaccccaca

SEQ ID NO: 24950 - DNA, 61 bp, Homo sapiens
gaggcaccctcaagcagtggcacgtgctgataggtaggcgacagcttgatggtgcgcacgc

SEQ ID NO: 24951 - DNA, 58 bp, Homo sapiens
gccgcatggctttcggccggccgttcagggactggctgccggacggcgactgcggcct

SEQ ID NO: 24952 - DNA, 82 bp, Homo sapiens
ggggcaggggcgccgaggccgccgcagaggccgctgggaggagcccgttgaggccctgcgcggccggcgcgctcattcacct

SEQ ID NO: 24953 - DNA, 65 bp, Homo sapiens
gggggcagggggtgggcggagggtggcagtgcccatctaacccaccctcctcctgcctgaccccc

SEQ ID NO: 24954 - DNA, 75 bp, Homo sapiens
acagcgctgggatcacagcctccccccgccccgaggtagcgggtggtgggaacgggattggaatcccgactgtgg

SEQ ID NO: 24955 - DNA, 58 bp, Homo sapiens
ggaggaggggaagggctgtgggcatccagtgggacccctccccatctccctccccctc

SEQ ID NO: 24956 - DNA, 64 bp, Homo sapiens
gcccgtgcccgcccggccgcctctgaccaggggccagttcgaggaggcccgggcccactggccc

SEQ ID NO: 24957 - DNA, 72 bp, Homo sapiens
tggggcgggggctgcgcaggggcagggagggggctgccgccgcacgcccgtgcgtctgtcctccgccgcaga

SEQ ID NO: 24958 - DNA, 75 bp, Homo sapiens
tggcccaggtagaggggtccgcgctggcggcggcggcggcgctgttccccgcgcggtccgcggagcggggtccgg

SEQ ID NO: 24959 - DNA, 71 bp, Homo sapiens
agcgaccctgcggcgcgcccggagctggcctgtttttgccgcctgaggctcgcggggcccgtgggacctgc

SEQ ID NO: 24960 - DNA, 63 bp, Homo sapiens
tgactttcctctccagccttcctcccactgtgggacccaggaccctggggcaggaaggccaca

SEQ ID NO: 24961 - DNA, 87 bp, Homo sapiens
gtcccgggtcttggtggtggaggggctgggccgtgaggtttatgtgacatggccgggccaccctccgtccgcagtggaagggcacca

SEQ ID NO: 24962 - DNA, 76 bp, Homo sapiens
cccctccctcctcccgtgagcgtccggccttgtgcatcctgaggccccgcgctgggcgggcctggagggtcgggcc

SEQ ID NO: 24963 - DNA, 75 bp, Homo sapiens
atcagggacttgggcgtggggggcggccaaaggcacccaagaggcggctctgccacccggccgtgtccctgcaga

SEQ ID NO: 24964 - DNA, 58 bp, Homo sapiens
ggggggccgtcctcggggcgccagataggtccccggcgcgcgagatccgcccctttgt

SEQ ID NO: 24965 - DNA, 73 bp, Homo sapiens
ggaccaacgcgggttctggggtgcacagcgccaggttaacgctgaagcctgccccgctgagcccaggagccgg

SEQ ID NO: 24966 - DNA, 53 bp, Homo sapiens
tcctggagctgggcagatgggaacagtccatccccggtgctctcctccagcct

SEQ ID NO: 24967 - DNA, 58 bp, Homo sapiens
cgcaagcgcaaccgtcggtgggtcggggatcggtcgcctgagaggtgagtgaggggca

SEQ ID NO: 24968 - DNA, 55 bp, Homo sapiens
cgcgctcacctgcgccggtagcgaagaaatcgccccgggacatggtgagtgtggc

SEQ ID NO: 24969 - DNA, 52 bp, Homo sapiens
ggggccgggcgggacccccggggcccaggctcccgtcctgcgccgccctcgc

SEQ ID NO: 24970 - DNA, 58 bp, Homo sapiens
gggtggggctgccctgggcactgcagggtgctgagcagtgtccgaggcctccacccac

SEQ ID NO: 24971 - DNA, 75 bp, Homo sapiens
tcctgcccttcccccatcagtgatcctatcccacactctttggcgatggtcagtgagctgggcaggggcgggggt

SEQ ID NO: 24972 - DNA, 63 bp, Homo sapiens
cccagggctccgcctctgctgctgaaggtgtgctctgggctgcagggacggggcccgtgggcg

SEQ ID NO: 24973 - DNA, 59 bp, Homo sapiens
catggggtgcgggagccgggcgggggtgactgtggccttgcctctcccgtccctgtagt

SEQ ID NO: 24974 - DNA, 60 bp, Homo sapiens
cgtggcccgaggggcagagctgggcgtcacttcgcaagcgtcctgccctgccggggcgcg

SEQ ID NO: 24975 - DNA, 55 bp, Homo sapiens
tggggcgcggagccccttcgcctccatgcgggtgaccccggctctgcgtcccagg

SEQ ID NO: 24976 - DNA, 73 bp, Homo sapiens
gccaccatatccagcctagcatatcattttcacatgtcaagaaatagtattctttggccaggcgtggtggctc

SEQ ID NO: 24977 - DNA, 59 bp, Homo sapiens
gtgggggtgagggtgggggaggcccgtgctttccctgctgagcctcctcccaccccagc

SEQ ID NO: 24978 - DNA, 73 bp, Homo sapiens
cccgccgcccgccgccctctgcccacgaccattccagccagtgcgcggggacccgggcggcgggcggtggggc

SEQ ID NO: 24979 - DNA, 63 bp, Homo sapiens
ctgggcggggatcgggggtccccggccccactgaccgtgcccgccccgtgccccgtccacagg

SEQ ID NO: 24980 - DNA, 57 bp, Homo sapiens
ggcctggagccgggctcccctcgccgggggccggtggcggtcccggcttccggctgc

SEQ ID NO: 24981 - DNA, 55 bp, Homo sapiens
tcgtagtccctccgccgtttgcagccggcaggtggcaagcggcttggactacaag

SEQ ID NO: 24982 - DNA, 53 bp, Homo sapiens
gagctgaccaggtgtgcaggccccggggcctccaggccgcacctggagcaaca

SEQ ID NO: 24983 - DNA, 77 bp, Homo sapiens
gggccggcggcggcggcgcctctagccggggcccatagggggcgggccgggagcggtcggcgcctacgcgagcccgg

SEQ ID NO: 24984 - DNA, 53 bp, Homo sapiens
cacgggggctgagagcagaaccccgagctggactctgctccctccccccagaa

SEQ ID NO: 24985 - DNA, 78 bp, Homo sapiens
ctggggtgggatttagcagggagcgggggggcacccagctgagggtcccaccgctgtccctgacccctaacccctgca

SEQ ID NO: 24986 - DNA, 110 bp, Homo sapiens
agattagagtggctgtggtctagtgctgtgtggaagactagtgattttgttgttctgatgtactacgacaacaagtcacagccggcctcatagcgcagactcccttcgac

SEQ ID NO: 24987 - DNA, 81 bp, Homo sapiens
ccccccactgctgggccggcttcccaagccgggttcaacttcaagggcaggggctggcgtgggatctggcccaggagggcc

SEQ ID NO: 24988 - DNA, 57 bp, Homo sapiens
tcgctgcgcgccgcgctccgggcggaccgagggacgcggggagcggctgcggcgggc

SEQ ID NO: 24989 - DNA, 68 bp, Homo sapiens
agggtgcatggtgtcgttgtggccgagccaggctaccaagtgacctctgaccccgctgtgcacccaca

SEQ ID NO: 24990 - DNA, 74 bp, Homo sapiens
gtgggagagcagctggggatgctgccttgggagcccatgctgcccagcacgtccatcaggtggtcacggagcca

SEQ ID NO: 24991 - DNA, 59 bp, Homo sapiens
cctggcttcctgagcacggcagaggaggagacgctgagccgagaactggagcccgagct

SEQ ID NO: 24992 - DNA, 61 bp, Homo sapiens
atggggtctcgcttgttgccctggctggtctttaactcctgggcttgagtgatactcctgc

SEQ ID NO: 24993 - DNA, 70 bp, Homo sapiens
ctgcacagggcagtgggggcaaaggggagcgtgccaggcagtgcccacccacccccgccgcctgcgcagg

SEQ ID NO: 24994 - DNA, 66 bp, Homo sapiens
tacgggagggaattggggtggcatggctctgggcccccagcagccacacctcgctcttccctcaga

SEQ ID NO: 24995 - DNA, 57 bp, Homo sapiens
ccagaggccgcacagcaggaacctcacattggatgtatctgctgttgtcccctcagg

SEQ ID NO: 24996 - DNA, 57 bp, Homo sapiens; identical to SEQ ID NO: 24995

SEQ ID NO: 24997 - DNA, 79 bp, Homo sapiens
tggtgggcgggcaggtgcaggtgggtgggctgcagagagcgggccggactcacaggccctccccttctctgcccacagt

SEQ ID NO: 24998 - DNA, 76 bp, Homo sapiens
gggtgcaggtgggggtggagggctgcagacgtggggccgccctgacctccagcctctgtcgcccaccgcctgtcca

SEQ ID NO: 24999 - DNA, 65 bp, Homo sapiens
gtgggtggggcaaggaggtgtgggggctgctctggcctgatgccccactcctgcctcaccccagc

SEQ ID NO: 25000 - DNA, 67 bp, Homo sapiens
agcgggaagcggggcaggtgtgcacctgcagcggcaaccctggtgcttctgtcccctcctcgcccag

SEQ ID NO: 25001 - DNA, 62 bp, Homo sapiens
tggggggcagggggcggtggcagaggccccagggaccctccaaccctccctctcctcccagc

SEQ ID NO: 25002 - DNA, 71 bp, Homo sapiens
tgcacgggtccgccctgagcgctcagtagcacggcggtggcggcgcagagcatcagggctgccccggccgt

SEQ ID NO: 25003 - DNA, 53 bp, Homo sapiens
cgggtgtttgtggtggggctgcggagtcgccgatcccgccggaagcgccagga

SEQ ID NO: 25004 - DNA, 66 bp, Homo sapiens
cgcccccaagctttcttctctccccatagactacagtttcgggtgaagaaggagggctggggcggt

SEQ ID NO: 25005 - DNA, 61 bp, Homo sapiens
cgcggcccctcctctgagagccacagtcaggtctgtcctcaggggtcgaggcggctgcgct

SEQ ID NO: 25006 - DNA, 68 bp, Homo sapiens
aggcgctgcggcaggagggaagatggcggacgaggagaagctgccgcccggctgggagaagcgcatga

SEQ ID NO: 25007 - DNA, 53 bp, Homo sapiens
ggcgctgctcggggagcgcgtgctcaacgcgtccgccgaggctcagcgcgcag

SEQ ID NO: 25008 - DNA, 55 bp, Homo sapiens
cgagcggggggcagaggcggcggctctccgcccccccctctgtccctcgtcccag

SEQ ID NO: 25009 - DNA, 86 bp, Homo sapiens
ctggggggcagtggcaggggggcggggtgggtgcttcctctggcccccagggagtgacctgttccacctctccatttctcccaggc

SEQ ID NO: 25010 - DNA, 50 bp, Homo sapiens
cgcggccatggcgcggccgcgcggcctaggccgcatcccggagctgcaac

SEQ ID NO: 25011 - DNA, 64 bp, Homo sapiens
aggctccgtttttccgctcgtcctccatggccgcggcggggcggggagcggagtccgagccagc

SEQ ID NO: 25012 - DNA, 54 bp, Homo sapiens
ggggaggcgcggcgatctgggctcggaaaagagacagggccctgacctcctcaa

SEQ ID NO: 25013 - DNA, 67 bp, Homo sapiens
accacagggcgctggtgatggagaagcccacatcctgggcccatccccggggccaaatgcctgaggt

SEQ ID NO: 25014 - DNA, 82 bp, Homo sapiens
tggctggctgaggtttggggaggatttgctggtgctagagaggaaagcagaccctacccaaccccacgccctactacagcca

SEQ ID NO: 25015 - DNA, 59 bp, Homo sapiens
tgggggatggctggggcacggagcgaggttccctgctaagctgcgcgctttcccccagg

SEQ ID NO: 25016 - DNA, 60 bp, Homo sapiens
ggggccgagggaccggctcgggggcgggggggaagtgtgcctgaccggtctctgtcctca

SEQ ID NO: 25017 - DNA, 57 bp, Homo sapiens
gcgaccccagggcgccactgccatcctgagttgggtgcagtcccgggattccgccgc

SEQ ID NO: 25018 - DNA, 89 bp, Homo sapiens
cccaaggtgtctccgccgcagcctctgtcgcgccgtgacctgtacaggtcgcgggagtcgtagggaggacgccgggacacctggaagcc

SEQ ID NO: 25019 - DNA, 81 bp, Homo sapiens
gcggggcccggcgcttcgtccaatcaggggcgctgggcggggcctgccgagtgtccatcggggagggcgaaggccctgctc

SEQ ID NO: 25020 - DNA, 55 bp, Homo sapiens
aggggaaggagggctggctgagtccaaggcctgacttcggcgctcttcccccaga

SEQ ID NO: 25021 - DNA, 71 bp, Homo sapiens
tcaagtgatggagagcaatacccggggatgactgtgaccacattgggatgtattcgtactgtctgatgggg

SEQ ID NO: 25022 - DNA, 71 bp, Homo sapiens; identical to SEQ ID NO: 25021

SEQ ID NO: 25023 - DNA, 73 bp, Homo sapiens
gccccgggggaaggagcccggccctgtctccgtcactcggatcctacgggaccgtgcgccccgccctgggtcc

SEQ ID NO: 25024 - DNA, 79 bp, Homo sapiens
ctgggtccctggaccgcgtcccgcgccccaaccatccaaccctggagatctggggacgcgggaagggtgggactcctgg

SEQ ID NO: 25025 - DNA, 56 bp, Homo sapiens
cagggacccaggagctgaaggcagggtgctccggccgagacttggagtgcgcaggc

SEQ ID NO: 25026 - DNA, 67 bp, Homo sapiens
cggggggagggtggcggaggccgggtgtctcggaggtgacggccggtcctcgctctctccccctgca

SEQ ID NO: 25027 - DNA, 71 bp, Homo sapiens
agggcaggtgggagctggggcagggggcaggggcgggcagcccttaccaggcccttgcatcctcccccagt

SEQ ID NO: 25028 - DNA, 57 bp, Homo sapiens
atcggctgggggctgggccaaagaccatcggggggtccaggaaagtcgggcaggtcg

SEQ ID NO: 25029 - DNA, 54 bp, Homo sapiens
gggtgggtgggctctgccctggctgagtgccagtgtcacagcccactctccctc

SEQ ID NO: 25030 - DNA, 64 bp, Homo sapiens
gcccgagcgcggccgccgcctgccgggcctcccctcgccgcggccggccgccgcgctcccgccc

SEQ ID NO: 25031 - DNA, 72 bp, Homo sapiens
tggtagcatgcacctgtggtcccagctacttgggaggctaagtagctgggaccacagctgcatgctaccacc

SEQ ID NO: 25032 - DNA, 71 bp, Homo sapiens
ggccccctttcccctctctctgcaggccaggagggcctccttcctgccacgagggaggggagtcgggcccc

SEQ ID NO: 25033 - DNA, 59 bp, Homo sapiens
agggcaggaggggccgccctttgggccatggcaccaacccggccctccttgtccacagg

SEQ ID NO: 25034 - DNA, 61 bp, Homo sapiens
gtcggggatggggaggggcgtggccggagcgcaaagccccgcccctccgcgcccccccccc

SEQ ID NO: 25035 - DNA, 82 bp, Homo sapiens
gtcctagcagtgtcactgcgtgggttggtttgtgtagagaggcgtgagcgagcccgttgtccggagtgcacctgctgcctgt

SEQ ID NO: 25036 - DNA, 90 bp, Homo sapiens
ggccggcggctcggggcccccgcagcagcagcagcagcagcagcagcagcagcagcagcaggcggtggccaggccgggccgggcggccac

SEQ ID NO: 25037 - DNA, 62 bp, Homo sapiens
ggggggaagggcacctagctaggacgtttgatttaggacctggttggggccactgacccctg

SEQ ID NO: 25038 - DNA, 82 bp, Homo sapiens
cggccagtgagtggggtggagcgcggccggcggccgcccccggccggtctcgggcccgcagcccgcccgcctgagcctcggc

SEQ ID NO: 25039 - DNA, 66 bp, Homo sapiens
gggggtggggtggagggaggccaggggccccgtctgggctggcctctccatcccaggccctgtcac

SEQ ID NO: 25040 - DNA, 81 bp, Homo sapiens
gggtgtgggcagtgggcgggccaaggacagtcccggggagctgccggggggcagttggcaccgtcccctgcgcctacccac

SEQ ID NO: 25041 - DNA, 65 bp, Homo sapiens
ggagggggagagggggtcgggccggacggggcctgacggtctcctctccgtctccatccccagct

SEQ ID NO: 25042 - DNA, 69 bp, Homo sapiens
cgggccgcggggacgggggcgggtggtgtcgttccagccgggccccggccccctcccccacggtccaga

SEQ ID NO: 25043 - DNA, 60 bp, Homo sapiens
gtgcagacaggtcagctcggcctggccctttggaaggcgaggccgggctgcactgcgaga

SEQ ID NO: 25044 - DNA, 65 bp, Homo sapiens
tagggcccagcaaaggggtggacactgagcgccccttcccagccaccccttgcgccgggcccggc

SEQ ID NO: 25045 - DNA, 51 bp, Homo sapiens
cggcggcctggccaggcgaggcgggagccgagcaggccggagcgggccgcg

SEQ ID NO: 25046 - DNA, 87 bp, Homo sapiens
cagcgggtcggcgggccgcaggagggggtcatgggtaaagactactaccagacgttgggcctggcccgcggcgcgtcggacgaggag

SEQ ID NO: 25047 - DNA, 89 bp, Homo sapiens
ggttgaggggcctgaaggcttttatttgactggtccatagggtggggggtgcaccccctacagggccaccttggggtccacttccccgg

SEQ ID NO: 25048 - DNA, 70 bp, Homo sapiens
tgacctcaggtgatccgcccgtaatcccagcactttgggaggccagggctgcggatcacttgaggtcagg

SEQ ID NO: 25049 - DNA, 69 bp, Homo sapiens
cggccttgggcccgtcccgcggcggcggtggcggtggcggtggtggtggcggcggcggcgggggtgggg

SEQ ID NO: 25050 - DNA, 64 bp, Homo sapiens
ggggccgagatgagggcagtatgtggacagacactgggcactactgtcactctctcgtccccca

SEQ ID NO: 25051 - DNA, 64 bp, Homo sapiens; identical to SEQ ID NO: 25050

SEQ ID NO: 25052 - DNA, 70 bp, Homo sapiens
gctgtgcagctctcgccggagccgagcccagccgagcgtccgccgctgcccgtgcgcctctgcgcctccg

SEQ ID NO: 25053 - DNA, 68 bp, Homo sapiens
ctgcagtggatgggagaggacacggctggtggggatcgggctcagctgggcctttctgtctctgcagg

SEQ ID NO: 25054 - DNA, 62 bp, Homo sapiens
cctggcactgagagggctctcttcccgttcaacagaagcagcccactctgaaggccagaccc

SEQ ID NO: 25055 - DNA, 62 bp, Homo sapiens
attgatggcatcgaaccaggtgccaggatgatgcctggcacctggtttgatgccatcattcc

SEQ ID NO: 25056 - DNA, 62 bp, Homo sapiens; identical to SEQ ID NO: 25055

SEQ ID NO: 25057 - DNA, 61 bp, Homo sapiens
aatgatggcatcaaaccaggtgccaggcatcatcctggcacctggttcgatgccatcaatc

SEQ ID NO: 25058 - DNA, 60 bp, Homo sapiens
tgtggcatccacccagggtggccgtgagttcttgacctccctgccgggggtgccacacag

SEQ ID NO: 25059 - DNA, 60 bp, Homo sapiens; identical to SEQ ID NO: 25058

SEQ ID NO: 25060 - DNA, 57 bp, Homo sapiens
ggctcccgggggcacctgcatactcacccgcctgggcctgggcccccggtgagcctg

SEQ ID NO: 25061 - DNA, 66 bp, Homo sapiens
gcgcgggccgggggcccagaggactcgcgtcccgccgccctggggccccggcgggggcgcgcgggc

SEQ ID NO: 25062 - DNA, 54 bp, Homo sapiens
gcccgctgagttggccgcagcccccgggcgagcggcggccaggccagaggacgc

SEQ ID NO: 25063 - DNA, 84 bp, Homo sapiens
ccccccgcccgccccgcgaatggaacgctgtgtgtcaaaccggccgcagcgcgaggccggcgcgcggggtcggtggcggtggcg

SEQ ID NO: 25064 - DNA, 88 bp, Homo sapiens
cgggccggcgggagggacgggggccgagcgctgggccgcggggcctgaccctcccccgcctccctctgcccctccccccgcacccccg

SEQ ID NO: 25065 - DNA, 72 bp, Homo sapiens
gggcgggggcagctgggaggcgagagggcggccccagcgtctgcagcctgcagcctcctctctgccacccct

SEQ ID NO: 25066 - DNA, 55 bp, Homo sapiens
tgaggcaggagttcaggctgcgggacacccctgcagcctggcttcgcgcctccgt

SEQ ID NO: 25067 - DNA, 59 bp, Homo sapiens
actcgggagcctgaggcacgagaattgcttgaacctcggagcctgaggttgctgtgagc

SEQ ID NO: 25068 - DNA, 67 bp, Homo sapiens
tggctggaggagctggggtgtcacctggcccctcctctaatctgccccatcccagtcctccacctta

SEQ ID NO: 25069 - DNA, 62 bp, Homo sapiens
cccagggtgggatgaggcttgggaaaaatagaagcagccctcttggcctcaccctctctagc

SEQ ID NO: 25070 - DNA, 63 bp, Homo sapiens
aggagggaggtgggggttggggaggctgcctgggcaccctcccttatggttccttcctccagg

SEQ ID NO: 25071 - DNA, 73 bp, Homo sapiens
gtgtgtgtgtgtgtgtgtgtgtcgggccgcacgtggcattgcccagaggcatgtacacacacaaccgttacct

SEQ ID NO: 25072 - DNA, 54 bp, Homo sapiens
gatgcagggtgaggcagggaggctccagctgagcctcctccctcatcttgcaga

SEQ ID NO: 25073 - DNA, 79 bp, Homo sapiens
ctccggctccgccccgcccctcacccgtcgggagcgccccctggcggcggcgaggacggcggcggcggcgcgcgcagca

SEQ ID NO: 25074 - DNA, 58 bp, Homo sapiens
ggggggtaggaggcggcgcggccgcaggcttgagcgctgccgccacctgctcactcag

SEQ ID NO: 25075 - DNA, 66 bp, Homo sapiens
gtggggtgggagggacactgggtgagccgcctggctgactgctcacagctgcccttgtccccagat

SEQ ID NO: 25076 - DNA, 66 bp, Homo sapiens
agcgggtcaggcagggccagtcacagacacagctctgtgctgactgcccgccttgcccacagctcg

SEQ ID NO: 25077 - DNA, 66 bp, Homo sapiens; identical to SEQ ID NO: 25076

SEQ ID NO: 25078 - DNA, 74 bp, Homo sapiens
gcgggggaggggccgcagcgcttttctccggaggtcgcgcgcccgagagcccgcgctgtccgccgccgctgcct

SEQ ID NO: 25079 - DNA, 76 bp, Homo sapiens
cggcggagcctacggtccctgcagtgcctgctgctgaggaggccaccgaagctcggggacgcgaggagccggcgtg

SEQ ID NO: 25080 - DNA, 51 bp, Homo sapiens
gcgcagacccaggggcgcgggcttcatgccccagccgtgccccctgtcccg

SEQ ID NO: 25081 - DNA, 51 bp, Homo sapiens
cccgccgcccccccggggccgggccgggccgggggcggggccgggcggggc

SEQ ID NO: 25082 - DNA, 59 bp, Homo sapiens
tgacgggcaggcatgggggctggagtggctgaccctgcctccccgtgtctgcctgtgtc

SEQ ID NO: 25083 - DNA, 82 bp, Homo sapiens
ctgcagtgttcagtgactgtgaacagccagcgcagccagcatgtgaaggtggctgtgtcacggaggcctgagactgccaggc

SEQ ID NO: 25084 - DNA, 52 bp, Homo sapiens
ctcagagccaaggggaagctgacctctaactcagtctcttcccctctctgcc

SEQ ID NO: 25085 - DNA, 58 bp, Homo sapiens
cctcagaaacgcacctgttcctgtaaacagcaaccaggtcaggattgttgctgggccc

SEQ ID NO: 25086 - DNA, 58 bp, Homo sapiens; identical to SEQ ID NO: 25085

SEQ ID NO: 25087 - DNA, 68 bp, Homo sapiens
cggggcgcgctcgggcggcgggggtgcgcgtgcgcgcgccggggcgctgaccctgggcgggaggagcc

SEQ ID NO: 25088 - DNA, 61 bp, Homo sapiens
aggggtgggcactgggtccagctgtcaagggcgctctggtcactactgtctccaccccaca

SEQ ID NO: 25089 - DNA, 67 bp, Homo sapiens
gcgactgtgggggtctgggacccgagtcccccaggcgcagctcgacccttggtcccctcggtcgccg

SEQ ID NO: 25090 - DNA, 50 bp, Homo sapiens
tctgctcctggctggctcgccaagaaatgtgggacacagaggactagaga

SEQ ID NO: 25091 - DNA, 74 bp, Homo sapiens
cgcacggggtcggcagcaggaagcccgcggggacagccttccctgacgctcgcccgcgccgacctctgagcgga

SEQ ID NO: 25092 - DNA, 61 bp, Homo sapiens
taggtaggatagtcaacatgtccctaattggctgggggacatgttgactctcctacctggg

SEQ ID NO: 25093 - DNA, 61 bp, Homo sapiens; identical to SEQ ID NO: 25092

SEQ ID NO: 25094 - DNA, 63 bp, Homo sapiens
gtatggcagcagtgtttttggagaatctcagagggatatttcagagggctgaggactagactg

SEQ ID NO: 25095 - DNA, 92 bp, Homo sapiens
actctgtcacaccctggttggagtgcagcttgtgcgatcagcagtgagccatgattgcacatctgcactacagcctgggtgtgacagtgtga

SEQ ID NO: 25096 - DNA, 59 bp, Homo sapiens
gggctgtagccgagggttccgccggcgcccgcccgccctctcggtagaccctcgcccgc

SEQ ID NO: 25097 - DNA, 54 bp, Homo sapiens
ccgcagcctgcggctcgaggcggagggcgacttcgacgtcgcggacctgcggga

SEQ ID NO: 25098 - DNA, 55 bp, Homo sapiens
acccttgccctcgggcctgcgagacccagagtgcaggcccgtggacaaggacaga

SEQ ID NO: 25099 - DNA, 64 bp, Homo sapiens
acctggacggcaggctggagcccctgtacgagcgcgtcggggcgccggcgctgcggccgctggt

SEQ ID NO: 25100 - DNA, 57 bp, Homo sapiens
ccgcctgcggggcgttccgttcgcagaaactctgtgagggacgccgcgggggcttcc

SEQ ID NO: 25101 - DNA, 73 bp, Homo sapiens
ggtggggagcggtaagggtaagggggcggtggcaccccagtacccacttgccctgccttcctctctccgcagc

SEQ ID NO: 25102 - DNA, 50 bp, Homo sapiens
ccgatcgcgccgggggccgaagaggaacgccgccccgcgccctctcgctc

SEQ ID NO: 25103 - DNA, 79 bp, Homo sapiens
ctcccggaaccggcccggagacgcgcaagaccccgcccaggccgaaggcgagctccggggccaggcagaccgtggagta

SEQ ID NO: 25104 - DNA, 53 bp, Homo sapiens
gccatgttgggtctgaagcggctgctgtaggcgccgacggagcgagcgggcgt

SEQ ID NO: 25105 - DNA, 79 bp, Homo sapiens
gccgcgatggcgctgttggccggcgggctctccagagggctgggctcccacccggccgccgcaggccgggacgcggtcg

SEQ ID NO: 25106 - DNA, 54 bp, Homo sapiens
tccctcctgtgcccctggcagccacgacaagggacccgaggcggaggagggcgt

SEQ ID NO: 25107 - DNA, 56 bp, Homo sapiens
ggagggctgggggcgctcggcgcggccctgaccgtgccccgaccctcctcggcccc

SEQ ID NO: 25108 - DNA, 56 bp, Homo sapiens
acgggatggaggaacagagaaagctaagggtagcctctgccctcctactccccagg

SEQ ID NO: 25109 - DNA, 77 bp, Homo sapiens
cagccctccctttccccgcctcgtatagacacccccaacatcgtggtgcccccagaggtggtggcaggcacggaggt

SEQ ID NO: 25110 - DNA, 80 bp, Homo sapiens
tggggggagtgcagtggcaggagggagagtgtccataaaacaccatcctgactcagctctggctctgctgtctccccagg

SEQ ID NO: 25111 - DNA, 80 bp, Homo sapiens
cagggcccttgtcacctgcatgcccacatccaccctgaacatgagggtgggggtgagatgctctgggaggggctagggag

SEQ ID NO: 25112 - DNA, 64 bp, Homo sapiens
tgttgtccccgcgggccgcctggaggtgtcctcgtagcgctagggaggcccgcaaggacacagc

SEQ ID NO: 25113 - DNA, 56 bp, Homo sapiens
gggggagaggggatgcggttccccacatgtgtgggtgaccctccctgctcccctgg

SEQ ID NO: 25114 - DNA, 69 bp, Homo sapiens
cccagcagtgagtcgcagccatgttcctggttaactcgttcttgaagggcggcggcggcggcggcgggg

SEQ ID NO: 25115 - DNA, 65 bp, Homo sapiens
tagtacctggcacatagtaaatgctgtgtcaatgttaaccatttactgttgctactattactagt

SEQ ID NO: 25116 - DNA, 62 bp, Homo sapiens
cgggcgctcgccctccgcctcctccaccaggcccgggaggagggggaggggagcgcctcgct

SEQ ID NO: 25117 - DNA, 71 bp, Homo sapiens
gctccgctcgcgccgcagccccaagaatgaatgaaatcgtagcgcgctgggcggcagagcgggcggcgcag

SEQ ID NO: 25118 - DNA, 66 bp, Homo sapiens
cagggccggggagcggccgcgcaggtgcctgccctttgcgcctgcgcccagctcgccctgcctagc

SEQ ID NO: 25119 - DNA, 76 bp, Homo sapiens
acagtcccattcctccactctgtatctatgcaaagcactctctgcagtcctccggggtgggtgggtgggcagggag

SEQ ID NO: 25120 - DNA, 56 bp, Homo sapiens
caagactgacaacgccggcgaccagcacggaggcggcggcggtggcggtggaggag

SEQ ID NO: 25121 - DNA, 59 bp, Homo sapiens
aggctgctgccccgggcggagaagcggcgtcggcggctggagcagaggcagcagccgga

SEQ ID NO: 25122 - DNA, 72 bp, Homo sapiens
tgctgggggcgggggagggagcggtggcgcagcctgggcggaggctcccaagctcacgcccctccccgcagg

SEQ ID NO: 25123 - DNA, 58 bp, Homo sapiens
aggtagggagggggtggcctggctgcgctgacccgcctaccgacccctctcgacctgc

SEQ ID NO: 25124 - DNA, 57 bp, Homo sapiens
ctggaacatggcagagggcatactaggggttaacctcctgccctttctcatgtcccc

SEQ ID NO: 25125 - DNA, 64 bp, Homo sapiens
ccctccccgggggcgcgggcgccgtgggagccgacgccgtccgcgccccccgctcggtggggac

SEQ ID NO: 25126 - DNA, 55 bp, Homo sapiens
ggcaggtgggtgggctggggcctgacctcctctccccaccccttcctcctgcagc

SEQ ID NO: 25127 - DNA, 99 bp, Homo sapiens; identical to SEQ ID NO: 18284

SEQ ID NO: 25128 - DNA, 69 bp, Homo sapiens
cccccgccggcctgcagtctagccgtagtgcgcctgcgcgcggctaggaggggccgtcaggcggggata

SEQ ID NO: 25129 - DNA, 70 bp, Homo sapiens
ggggtagagggcggggctgcggcagggtctgggcctgtttgctgacctctgtcctgccctgcttcccagt

SEQ ID NO: 25130 - DNA, 54 bp, Homo sapiens
agggggtcaggaagaggtgggggtgccagcttcccctcttccctgtcctccagt

SEQ ID NO: 25131 - DNA, 59 bp, Homo sapiens
gctctatggtcgggtacctgacgtggaacgggcgctctgcacgcgaccatagagccttc

SEQ ID NO: 25132 - DNA, 57 bp, Homo sapiens
cgctcagcccattcccctgcatcctgcggggaatgcagcgtggatggcgctgggtat

SEQ ID NO: 25133 - DNA, 61 bp, Homo sapiens
cgggtgaggaccatgggggcctggctccaggagtccctggccctcacacatgcctccccca

SEQ ID NO: 25134 - DNA, 69 bp, Homo sapiens
gggggcatggccacgggggcaggtcagcaggggtgactccagcccgtgactcacccctcccacccttca

SEQ ID NO: 25135 - DNA, 51 bp, Homo sapiens
gggttgggaaggtgatgggggaattcatgccccccacccccatctgcccct

SEQ ID NO: 25136 - DNA, 83 bp, Homo sapiens
gaggtctctgggttgtgcgtggtgctgttgtgtgtccagtccgcgcgaggaacacgctcacgcgcggctcggcccgcctcccg

SEQ ID NO: 25137 - DNA, 56 bp, Homo sapiens
gggggcggcgggggggggggcatgcggcgacggcctcccgctccccccgggcccaa

SEQ ID NO: 25138 - DNA, 62 bp, Homo sapiens
cagggaggtgtggggagaaggtccgctttagagcttggtccctctgtgctcacctcccagcc

SEQ ID NO: 25139 - DNA, 57 bp, Homo sapiens
ggcactcgctctcagggtcctgtaagtgcagggtccgcacctgtgagtgagcgcctc

SEQ ID NO: 25140 - DNA, 57 bp, Homo sapiens
tggtggggtggaggaggagagaagctggaggcctcaatccatccccatcccctcagc

SEQ ID NO: 25141 - DNA, 73 bp, Homo sapiens
cgcgaaacgcctgcgggagccaaatttcctgcgcatcgaccgggcaattagactcccgcaggcgtttcgctgg

SEQ ID NO: 25142 - DNA, 63 bp, Homo sapiens
gcctcgggctggcctccaccaagctcacgtgcgagggtagggtacggggccgggccagggtgc

SEQ ID NO: 25143 - DNA, 80 bp, Homo sapiens
ctcctggacgcggcgctgaccggggagctggaggtggtgcagcaggcggtgaaggaggtgagcgctgctgagcgggaggt

SEQ ID NO: 25144 - DNA, 64 bp, Homo sapiens
tctgggcgaggaggggatggagcctgggtgcctcctcatagcccccctccccctcccccagacg

SEQ ID NO: 25145 - DNA, 81 bp, Homo sapiens
gggggcggggaaggggggccgggcctggatccggcggggaggccgagccggaggccggaccgtggctcgcgctgtccccgg

SEQ ID NO: 25146 - DNA, 68 bp, Homo sapiens
ggagggagccagggtggggaggctgaggactcctgggtgctccttgacgccctcaccctgccctcaga

SEQ ID NO: 25147 - DNA, 70 bp, Homo sapiens
gcccccccgccggccgtcccggcggccattgctccaagatggcggcggcggcggcagcgggtgaggccgg

SEQ ID NO: 25148 - DNA, 60 bp, Homo sapiens
ccaacccagcagtccttccctcagctgcctaggaggaagggacccagctgggtctgggcc

SEQ ID NO: 25149 - DNA, 65 bp, Homo sapiens
cttcccctccccgccccccgccccgagggagagccgcggcgcggcggcaggaggaggtggaggag

SEQ ID NO: 25150 - DNA, 70 bp, Homo sapiens
tcctcggcggcctagtccctggccctggccctggccctggctcgggctccggctatgccagccgcggcgc

SEQ ID NO: 25151 - DNA, 73 bp, Homo sapiens
gagccctgatccggatgctggggcgcgggggagctgaagggatccgcgctcccagaccgccggtccggctggg

SEQ ID NO: 25152 - DNA, 71 bp, Homo sapiens
ccgcctccccaggagtccacattccaggagctgtgcgaggggctgctggaggagtcggatggtgaggggga

SEQ ID NO: 25153 - DNA, 56 bp, Homo sapiens
tccttcgagaccggttcaagagcttccagaggaggaatatgatcgagcctcgagag

SEQ ID NO: 25154 - DNA, 55 bp, Homo sapiens
gcaggttcccgccgcactcgcgcagacctagcgcgtccaggtgggaggttagtgt

SEQ ID NO: 25155 - DNA, 63 bp, Homo sapiens
tgagggaggtggggtggggtgaggacttggaagtctgagttctgtccaccttgcttcttcagg

SEQ ID NO: 25156 - DNA, 58 bp, Homo sapiens
gacggcctctcagtggctcccggaggacccggcgggcccagtgttggaggtgaggagg

SEQ ID NO: 25157 - DNA, 51 bp, Homo sapiens
acagagttgcgcttgctgccgctggtggaggaggtgcaggacgctcggcgc

SEQ ID NO: 25158 - DNA, 55 bp, Homo sapiens
ggaggggcggtggggggatgacgtggtggtgacgtctccctcccctgctcccagc

SEQ ID NO: 25159 - DNA, 70 bp, Homo sapiens
ccttcccctcccccctcccccagccgccttgtgcaaagatggctgcaccgtgagcgcagaggaggaggag

SEQ ID NO: 25160 - DNA, 54 bp, Homo sapiens
ggcgcccaggggggcggggagggggtccgaccctcctgacgcccccagccctcc

SEQ ID NO: 25161 - DNA, 79 bp, Homo sapiens
cccatcagggctcagggattggatggaggtgatgggggcaggggatgggtctcaccctcccttcttcctgggccctcag

SEQ ID NO: 25162 - DNA, 58 bp, Homo sapiens
ctggcgggcggggcctcgggtgggctgctgcgggctcaccccctccctgcctgcctcc

SEQ ID NO: 25163 - DNA, 72 bp, Homo sapiens
gcaggcagcgggggtggagggagactgagcagccctggaggccggccacctcacccctcgttgctgttgctc

SEQ ID NO: 25164 - DNA, 60 bp, Homo sapiens
cggggctgtccaggggagcgctgcgggcttggctgcagcctgaccccatgtccccccagg

SEQ ID NO: 25165 - DNA, 58 bp, Homo sapiens
cgggctgcgcaggctgctgctgctgcggcggcagcggtggcggcggcggggactcggg

SEQ ID NO: 25166 - DNA, 50 bp, Homo sapiens
cgcgctctcccccctccccggctcctgggtggggagggggcttccgcagc

SEQ ID NO: 25167 - DNA, 81 bp, Homo sapiens
gggcgggagcctggcgcagccggcagaccgccagcagatggaggcgctcactcggtacctgcgcgcggcgctcgctcccta

SEQ ID NO: 25168 - DNA, 59 bp, Homo sapiens
gccgggggccacaagggcaggatgggcccaggcctttcctaccccgaggcccccagctg

SEQ ID NO: 25169 - DNA, 56 bp, Homo sapiens
gtgtgggggggtgggggcgggggcagcctcctcccttccccttcctccccaccttg

SEQ ID NO: 25170 - DNA, 63 bp, Homo sapiens
ggcccatggccctatcatcagcaagatggaggtagagctgaggatcgagccatgggctaccgg

SEQ ID NO: 25171 - DNA, 51 bp, Homo sapiens
aggggcctgggcttgtaaaataccagattttacaagcctctgagccccaca

SEQ ID NO: 25172 - DNA, 97 bp, Homo sapiens
accaagtgatattcattgtctacctgagctagaatacaagtagttggcgtcttcagagacacttgtatgctagctcaggtagatattgaatgaaaaa

SEQ ID NO: 25173 - DNA, 54 bp, Homo sapiens
ccactacgccctgatgtcccttttaaaaagtactatgggccaggcgtggtggct

SEQ ID NO: 25174 - DNA, 83 bp, Homo sapiens
tcatgctgtggccctccagagggaagcgctttctgttgtctgaaagaaaacaaagcgctcccctttagaggtttacggtttga

SEQ ID NO: 25175 - DNA, 59 bp, Homo sapiens
ggggcgggggcggggccgggggtggcctcgaggctcccgtctgaccgtccccgcccagg

SEQ ID NO: 25176 - DNA, 91 bp, Homo sapiens
ggcgggggcgcgggcggcagtggcgggagcggcccctcggccatcctccgtctgcccagttaccgcttccgctaccgccgccgctcccgct

SEQ ID NO: 25177 - DNA, 72 bp, Homo sapiens
ccggggcaacacattgagactccatctctacaaattcttgagatggagtctccctctgttgccccgctcgct

SEQ ID NO: 25178 - DNA, 82 bp, Homo sapiens
ggaggggatggggtgggaggggacggtggcccccggggtcctgggacccgctgagattcctctccctcctcctccgctcagc

SEQ ID NO: 25179 - DNA, 79 bp, Homo sapiens
gtggctgagagccctaagaagaagcggtgggaggccgctagcagccttcaccctcctagaggggcaggctcggcgacaa

SEQ ID NO: 25180 - DNA, 74 bp, Homo sapiens
gcggggtgggagaggtggggtctgcgtgcgggccgggccggcccctgacgcgcgctcctcccctgccccagcac

SEQ ID NO: 25181 - DNA, 84 bp, Homo sapiens
agcgccgcgcccgcaccgtccgcttcgagcgcgccgccgagttcctggcggcctgtgcgggcggcgacctggacgaggcgcgtc

SEQ ID NO: 25182 - DNA, 77 bp, Homo sapiens
tgtggggctgtgctgggctatgctggagtggggtcctgcccaactccctccagccctaacctccgcacccccacagg

SEQ ID NO: 25183 - DNA, 80 bp, Homo sapiens
ggggctggggcgggcgggcggggggcaggcggcaggggagggcggcctgacacatcctgactcaccctccctgcctgcct

SEQ ID NO: 25184 - DNA, 56 bp, Homo sapiens
ctgcggggaccacttgcaccatctgggaggctggagccccggggagccccgcgggg

SEQ ID NO: 25185 - DNA, 67 bp, Homo sapiens
ggaggggggggtgcaggggggcacctgcagcacctgcttccagctgcacctgtgcctccccttcccc

SEQ ID NO: 25186 - DNA, 69 bp, Homo sapiens
cggctgggggagggtgggggcagggctggctgggggcttctccccactcccgccccccccttatccccc

SEQ ID NO: 25187 - DNA, 68 bp, Homo sapiens
cggcggctcccctcccccgcccggctctccgcgccccttctgggcggcggggcggcggagccgtcggc

SEQ ID NO: 25188 - DNA, 64 bp, Homo sapiens
cgtgcaggtgtgtgactggctgtgagcctgtccctgagtgtcacagcgtctgcacctgctcact

SEQ ID NO: 25189 - DNA, 56 bp, Homo sapiens
cctgcctcatcacaattgccccacaaagatagtgcaattgtgtttgtggcccacac

SEQ ID NO: 25190 - DNA, 58 bp, Homo sapiens
tggacctgcggagggcggcggtgaccactgggcctcactccgctaacccaggtccgca

SEQ ID NO: 25191 - DNA, 62 bp, Homo sapiens
tggctcctgagggtacctcagccccaggtggtggcccgggaaccctggatgacagtgccacc

SEQ ID NO: 25192 - DNA, 63 bp, Homo sapiens
atgaggcccgcagcatccgcgacctggccagccaccgcggcctgctgcggcagggcatcgtgc

SEQ ID NO: 25193 - DNA, 62 bp, Homo sapiens
ggtgggggggggtgggggtcaacacagccacctttgtgctgtcccctggtctcctccgcagc

SEQ ID NO: 25194 - DNA, 79 bp, Homo sapiens
gggagcggggctgaagccctgggcccggcagaggaaggtcgagatggaccatgttgggccccttctctccccgccccca

SEQ ID NO: 25195 - DNA, 86 bp, Homo sapiens
ccctccccggccagctcccgagcctccgcgcagcccgcccgccaggatgggtggggagaagaggcagggagtggaggaggaggtga

SEQ ID NO: 25196 - DNA, 64 bp, Homo sapiens
gggctgcgcgggcgcggggaggcgcgggcggcaaactgcgggcacccggcaccccgcagccagt

SEQ ID NO: 25197 - DNA, 57 bp, Homo sapiens
aactgcctgaagtcaaccaacagagtcttgtctattggttgacttcgggtcaggaaa

SEQ ID NO: 25198 - DNA, 61 bp, Homo sapiens
cgggcaggggagggaggcagggaaagcgaagccgctcctcactcacacgcgtctccccgca

SEQ ID NO: 25199 - DNA, 55 bp, Homo sapiens
ccccatgggaatcaggtcgaggcagggccctgctttgacctctccccatgctgct

SEQ ID NO: 25200 - DNA, 63 bp, Homo sapiens
aatcctcactttgaatccatgttggaaactccatagcaacatggagttcaggtgaggattaaa

SEQ ID NO: 25201 - DNA, 63 bp, Homo sapiens; identical to SEQ ID NO: 25200

SEQ ID NO: 25202 - DNA, 61 bp, Homo sapiens
tggtcgtccttgcgggcccgggcgggagatgtccgttcctcgggcgggtcgggcggccggc

SEQ ID NO: 25203 - DNA, 63 bp, Homo sapiens
gcgagcgaggctcaccgtccccggcgtgcaggatccggggctgctgagcgctcgctcccgcgt

SEQ ID NO: 25204 - DNA, 77 bp, Homo sapiens
cacctggccctggagggaagccctgggaaggctggctaggctgcctcctgggctgcctcctggggctgcagccggtc

SEQ ID NO: 25205 - DNA, 60 bp, Homo sapiens
agggcggggacgcggtgacgcgggcactgccgggtcccgtgactgcgcgccccgcccgga

SEQ ID NO: 25206 - DNA, 78 bp, Homo sapiens
cggcggccaggacctgggtctccctccggcgccgcatccgaggcgctccagcccggcccggctcttacctccggcgcg

SEQ ID NO: 25207 - DNA, 55 bp, Homo sapiens
gcccgcgagctccgacagtgcgcccgggacagcgcgcccccagcccgccgggcct

SEQ ID NO: 25208 - DNA, 67 bp, Homo sapiens
cgcatgtgaagccacaggatgaccgtggagttggcatttcctttcatcctgtgtcctccatgtattc

SEQ ID NO: 25209 - DNA, 67 bp, Homo sapiens; identical to SEQ ID NO: 25208

SEQ ID NO: 25210 - DNA, 82 bp, Homo sapiens
ggattgtggggggtcgctctaggcaccgcagcactgtgctggggatgttgcagctgcctgggagtgacttcacacagtcctc

SEQ ID NO: 25211 - DNA, 63 bp, Homo sapiens
ttttgtgtcttttgcctttttaaaggaattgttaacattggaattgagggtatgtacagagaa

SEQ ID NO: 25212 - DNA, 73 bp, Homo sapiens
gggccgggcggaggagggcggtgggtggtgctgaagggacagctccgcggcggcggcggcggcggcggccccg

SEQ ID NO: 25213 - DNA, 59 bp, Homo sapiens
gccgtcccacgggccagccccgccgtggccgtggccgtggctggcccgtggggcgagga

SEQ ID NO: 25214 - DNA, 59 bp, Homo sapiens; identical to SEQ ID NO: 25213

SEQ ID NO: 25215 - DNA, 55 bp, Homo sapiens
tcctggggtctcgcctgagacggggcacctagccctgggcgagcgccgcacccgg

SEQ ID NO: 25216 - DNA, 63 bp, Homo sapiens
aaagctataagatctctgtgtctgtctgtatacacaaacagacacagagatcttatagctatg

SEQ ID NO: 25217 - DNA, 74 bp, Homo sapiens
ccggaaagcacctcggtgccccgcgaccctccgaacagaggcggcgggaggtaccagctgctaccaccgctgcc

SEQ ID NO: 25218 - DNA, 63 bp, Homo sapiens
tcagccaccgcaccaggccagttcattagaatttttaaaacaggctgggcatggtggcttacg

SEQ ID NO: 25219 - DNA, 77 bp, Homo sapiens
tggtgattttgaacgtagctatccaccactcagcctggaaaaagctgagtgattgatagctatgttcaaaatcacca

SEQ ID NO: 25220 - DNA, 58 bp, Homo sapiens
agccagtgctgtggcattggagactacggagagagtcttctctaccagcactgcatga

SEQ ID NO: 25221 - DNA, 70 bp, Homo sapiens
cacgtgaaaccctgtctcttaaaaaaaaaaaaaaaaaaatttagctaggcatggttgcatgtgcctgtag

SEQ ID NO: 25222 - DNA, 62 bp, Homo sapiens
gcgccccttcctccctccctccccgtcccgtcctggggccggagggcggggggccggggcgc

SEQ ID NO: 25223 - DNA, 75 bp, Homo sapiens
gctgctggtgcgcggcagcgcggacggcgccttcctcgacccgaggccgctgaccgtcgtggccgtggccaacgt

SEQ ID NO: 25224 - DNA, 64 bp, Homo sapiens
gcgcgagggcagcaaccgcaccaggggctgtggcgccggcgacggaccagcgacccaagcgccg

SEQ ID NO: 25225 - DNA, 57 bp, Homo sapiens
aaaagtagttgctggttttgttactacttttaaattaaaaccagcagttacttttgc

SEQ ID NO: 25226 - DNA, 58 bp, Homo sapiens
tgtccccatcccagatggctcctgtcacagtttggctgccctctctgatggagaccag

SEQ ID NO: 25227 - DNA, 90 bp, Homo sapiens
agtggccaaagtacaaacatttgccctggttctttgagtctcaggaagttgcacaggaaccagggcaaatgtttgtactccggccgctgc

SEQ ID NO: 25228 - DNA, 90 bp, Homo sapiens; identical to SEQ ID NO: 25227

SEQ ID NO: 25229 - DNA, 51 bp, Homo sapiens
accccatctcccaccacacatgaatcttcaggcatgtgtggtgggagatgc

SEQ ID NO: 25230 - DNA, 89 bp, Homo sapiens
cgttgttggcgcacgaggccgacgagcaggccgcgcacggggcccccggcgccagcaggtcctcggcgcccccggtgccgtacagcaga

SEQ ID NO: 25231 - DNA, 52 bp, Homo sapiens
ctggcgccgggggccccgtgcgcggcctgctcgtcggcctcgtgcgccaaca

SEQ ID NO: 25232 - DNA, 54 bp, Homo sapiens
gggtttagaggtctctgttgctgccctgggagcaacagaaacctctaaacccga

SEQ ID NO: 25233 - DNA, 96 bp, Homo sapiens
gctccagtaacatcttaaagtaaatatgcaccaaaattacttttggtaaatacagttttggtgcatatttactttaggatgttactggagctccca

SEQ ID NO: 25234 - DNA, 70 bp, Homo sapiens
ttggtgcagaagtaattgtagttttgtcattacttttaattgcaaaagccacaattacttttgcaccagc

SEQ ID NO: 25235 - DNA, 74 bp, Homo sapiens
ccctgaccaccagtatagcatagtgacagatttgagagatgctctgatttcagtgttctttaaaaggtggtgtg

SEQ ID NO: 25236 - DNA, 52 bp, Homo sapiens
agagcccgtgtggaccccgccagccccggctcccgccgcgcccccctccacc

SEQ ID NO: 25237 - DNA, 52 bp, Homo sapiens
cggcgcgaccgctctcggctttggggaccggatggaggagcggcgtgtcggc

SEQ ID NO: 25238 - DNA, 110 bp, Homo sapiens; identical to SEQ ID NO: 10905

SEQ ID NO: 25239 - DNA, 60 bp, Homo sapiens
gcgcgagtttgatcggggcgcgcggcagcgttctctttgcttcccccggactcggccggc

SEQ ID NO: 25240 - DNA, 89 bp, Homo sapiens
ggtccctggcggctcctgtagcgtccccagttacggcgcccatagcaaccggctccctagctaggcgcccccgggttgccaggggccgc

SEQ ID NO: 25241 - DNA, 58 bp, Homo sapiens
tgcccaggatggagtgcagtgaactgtgatcataccactgcactccagcctgggcaac

SEQ ID NO: 25242 - DNA, 60 bp, Homo sapiens
agtggctcccacctcccgcgtcctagagatggggaggcgaggagagagggagcaggctga

SEQ ID NO: 25243 - DNA, 67 bp, Homo sapiens
tgagcaacacagtgagactccttttttttttttttttttgagacggagtctcactctgttgcccagg

SEQ ID NO: 25244 - DNA, 63 bp, Homo sapiens
gccgagcaggcggtgctgccgcccgccgccgctcgccccgccgcggccgcccctgctcctgct

SEQ ID NO: 25245 - DNA, 61 bp, Homo sapiens
ccagcctcagtctctgtatcctgagattttgccagataggttatagaaactgaggctcttc

SEQ ID NO: 25246 - DNA, 79 bp, Homo sapiens
cgcccgaccccgcaggacgcgtgtgccggccacaagcgcgtgcacaggcactcacgcgccgcggggcccctcgggcggc

SEQ ID NO: 25247 - DNA, 70 bp, Homo sapiens
cagaggagggtggagcaagtggtctttctgatgcctgtgcgtgctgccatttgccttctctttccccagg

SEQ ID NO: 25248 - DNA, 70 bp, Homo sapiens; identical to SEQ ID NO: 25247

SEQ ID NO: 25249 - DNA, 64 bp, Homo sapiens
cggggcctgggtgggaagagtcacaggtacagaggctcctgtgacattcacactctgcccctgc

SEQ ID NO: 25250 - DNA, 91 bp, Homo sapiens
ggggtggggtcggtgggggtgctggaggcgggggcgcaggcctaggctcagtgcgccaacccctagatttatacccacacccacactcatg

SEQ ID NO: 25251 - DNA, 66 bp, Homo sapiens
gcaccgtcgtcctgtcgtccgcggggcggggacgcggcggcggcggcggcggtggcggctgtgtgt

SEQ ID NO: 25252 - DNA, 87 bp, Homo sapiens
ccccgcggggtctcgccagcccgtggcccggagcctggaaatatttattccgagaggctcccgagcgcggggtgggggtgtgggggt

SEQ ID NO: 25253 - DNA, 58 bp, Homo sapiens
tgtgctgacgcggctggcagagcatctgggtgaggctgaggtagctgctgagctgggc

SEQ ID NO: 25254 - DNA, 63 bp, Homo sapiens
gccgcctctccgagctcttgtgacgcggacctcagtgccaggatggctcggggcgagcggcgg

SEQ ID NO: 25255 - DNA, 64 bp, Homo sapiens
tccctctcagcttctctcctgcgttcgtgggaatccaaagtccagagggggctgaggtgggagg

SEQ ID NO: 25256 - DNA, 62 bp, Homo sapiens
tggctattctagcagtgaagttgctagcagtcatggacaacttcactgctagcatagccagc

SEQ ID NO: 25257 - DNA, 58 bp, Homo sapiens
aaaagtaattgcggcatttgccattcaaagtaatggccagaactgcagttacttttgc

SEQ ID NO: 25258 - DNA, 64 bp, Homo sapiens
aagggtttgggtctgagctgtatagtatgtcaaactgccagtaagccagcccctcaccctctga

SEQ ID NO: 25259 - DNA, 52 bp, Homo sapiens
agccttggagcggggcaaaggtaccccttagtgccgttgatctccaggggca

SEQ ID NO: 25260 - DNA, 54 bp, Homo sapiens
cggcgcctctcaggcgggcgggcactgcggcccggcccaggatggggcgtcgcg

SEQ ID NO: 25261 - DNA, 60 bp, Homo sapiens
cggccgcgccgtcgcaggcacccgaacgtcgcgagcggggcctggggacgcggggccgag

SEQ ID NO: 25262 - DNA, 90 bp, Homo sapiens
atcccatgttgaactgaacatttcttccctttagcagaaacaagccttgtttctgagagctgaagaaatgttcagttctacatgggatat

SEQ ID NO: 25263 - DNA, 65 bp, Homo sapiens
cctctccgccacctccaccgcggcttatcccctggctggcggcgttggcggggcgggggacagta

SEQ ID NO: 25264 - DNA, 61 bp, Homo sapiens
acttctgcctgtcctgcccaaatcgtggagcagattcgaggggcagggcaggcataagtgg

SEQ ID NO: 25265 - DNA, 61 bp, Homo sapiens; identical to SEQ ID NO: 25264

SEQ ID NO: 25266 - DNA, 60 bp, Homo sapiens
cactgcttcctgccatctgtcccgagtgatggaaatagagccagtgacagcaagcagtgc

SEQ ID NO: 25267 - DNA, 63 bp, Homo sapiens
ttgcagatgaaaatatctaggtaaatcacctcactgtgccttgatttcctcatctgtaagatg

SEQ ID NO: 25268 - DNA, 61 bp, Homo sapiens
gttcctcgcactgcctcctccgaaacaccagccctctggcggaggggcggtggggggaccg

SEQ ID NO: 25269 - DNA, 76 bp, Homo sapiens
atgggcgggcgggcggggggccgcggcagggaaatccgatcccacaacatcggcctccctccaagcccgccccaaa

SEQ ID NO: 25270 - DNA, 65 bp, Homo sapiens
ccctccgggtgtccagcagccccggggctcggagtcgcgggctgcgccacagcgcctggagggag

SEQ ID NO: 25271 - DNA, 61 bp, Homo sapiens
aaaagcaattgcggtttttgccgcaattacaagtaatggcgaaaaccgcaattgcctttgc

SEQ ID NO: 25272 - DNA, 57 bp, Homo sapiens
ggggagggagggcagcggcgccgcgtcgggagccgccgccgtcccggtcctcccgcc

SEQ ID NO: 25273 - DNA, 63 bp, Homo sapiens
ctgagactggggagagtagcagggccctctgcctgacagccctgcccctctctcatgtccagg

SEQ ID NO: 25274 - DNA, 90 bp, Homo sapiens
ctccgccggcagccgcgggagcacggcgacgccagcggcgggtgaggggctcgcggcggcagcggcggcgcgcgggggcgggagggggcg

SEQ ID NO: 25275 - DNA, 61 bp, Homo sapiens
taaagtctttgttgtcccccaccccaccctttgtttgtgggggacaaacaaagactttaca

SEQ ID NO: 25276 - DNA, 76 bp, Homo sapiens
tgtttcatgcttctagcctcattaaaccatcattaaggaattttcttattggccttgtgcagtaggtatacaacag

SEQ ID NO: 25277 - DNA, 51 bp, Homo sapiens
gctccgcgcggtcgcagccaggacactggggcggcggcggcggcgggaccg

SEQ ID NO: 25278 - DNA, 76 bp, Homo sapiens
gagtgacagcgtgaggctgggagggaggacttggcttgagcttgttaaactctgctctgagcctccttgtcgcctg

SEQ ID NO: 25279 - DNA, 73 bp, Homo sapiens
cggggctagctgcgcctgctgcgctccgcgggctctcagagcgctgggcaccggccgggctgtggtccccgcg

SEQ ID NO: 25280 - DNA, 85 bp, Homo sapiens
gtgctcatttaagtagtctgatgcctactactgatgacatacaatgtaagtgctcatttaggcgtcagactacctaaatgagcac

SEQ ID NO: 25281 - DNA, 58 bp, Homo sapiens
cggagggcggctgagggctgctgagggtacgcgcagcggcctctcgtcgccctgcacg

SEQ ID NO: 25282 - DNA, 84 bp, Homo sapiens
cttgtaaggtagaaagcactatggtttgaaatgaagctccagattctcccattttaaaatcaaagtgtgcacattttcaggata

SEQ ID NO: 25283 - DNA, 74 bp, Homo sapiens
gggtcggcgcggcggcggcagcggcggcggcggcggcggcggcggcggcaggggcggcggcggtgctgacggcg

SEQ ID NO: 25284 - DNA, 59 bp, Homo sapiens
gcccgggaagcagaaggaacgtgggctggtaagcaacagaccttctgcttcccgggctg

SEQ ID NO: 25285 - DNA, 52 bp, Homo sapiens
agggccctgcagtgacggcgccccggccccacactcgcctcccgggccccac

SEQ ID NO: 25286 - DNA, 63 bp, Homo sapiens
ttcgggctcccctcgggcagaggcgtgtagtgtagccctgtgtccagcaggagcccggcacct

SEQ ID NO: 25287 - DNA, 53 bp, Homo sapiens
cctccccgcgcccccggcccggcagctcggcccgccggcgagcgcaggcgggg

SEQ ID NO: 25288 - DNA, 59 bp, Homo sapiens
actgccggtccccaaccccaagagggacggaaagttcttggggtagaagccggcgggac

SEQ ID NO: 25289 - DNA, 51 bp, Homo sapiens
gggcccggacgcagccacgccgccacccgagcgctgggggtcggggctccg

SEQ ID NO: 25290 - DNA, 76 bp, Homo sapiens
atgcgcggggcaggtgaggctgcgcggggcggagcctgtggccctggcgcggctctgggtccgtctcgtcgcgtcc

SEQ ID NO: 25291 - DNA, 88 bp, Homo sapiens
ccggccgggggcggggccggcgctggcgagcagcgaccccggctcggggaggcgggcgcggccgggccgacctcccccgcggccgcga

SEQ ID NO: 25292 - DNA, 80 bp, Homo sapiens
ggagtgttgcagtcgtacattcgcgcgccgccgggcggggagcgcgggggtggcgcggtgcaggcgcagagacacacgta

SEQ ID NO: 25293 - DNA, 75 bp, Homo sapiens
cgcggagggcaagccgggggcggggccggggccagagcagatctccgggcctccgcggccatagctgactgtgcc

SEQ ID NO: 25294 - DNA, 73 bp, Homo sapiens
ccggggagccgggatgggggtcaccgcccccggggagccgggatgggggtcaccgcccccggggagcccggat

SEQ ID NO: 25295 - DNA, 70 bp, Homo sapiens
accagaaggtccagggtccaggcatgggaagcattctctgacaataccgagccctcgggacctcctgaaa

SEQ ID NO: 25296 - DNA, 70 bp, Homo sapiens; identical to SEQ ID NO: 25295

SEQ ID NO: 25297 - DNA, 70 bp, Homo sapiens
tggtatctggaaaatagcttcacaagttgggaccaaggttaaaactgctgaggacaacagtaatacccca

SEQ ID NO: 25298 - DNA, 66 bp, Homo sapiens
cggcggcggcggcgactccgggcggcctcagcctgagcctcagtccgggcgccagcggcagcagcg

SEQ ID NO: 25299 - DNA, 58 bp, Homo sapiens
cgccggcccgcggctgcccagcagcatgaggtggtgctggcggctccgggtcgtggcg

SEQ ID NO: 25300 - DNA, 73 bp, Homo sapiens
cccgccccggccggcagggaggatgtgagctcactcccgcctccatgttcccggagtcgcctggaagcgtccg

SEQ ID NO: 25301 - DNA, 73 bp, Homo sapiens
gcgccggcctggtttgcagctcccaaacaatggccacattgtcgcagccgcacaccggccgccgccggcgagt

SEQ ID NO: 25302 - DNA, 86 bp, Homo sapiens
ggcgacaggccgagagttcgtctcaaaaaaaatttttttcttttttttttttttttttttgagacggagtctcgccctgtcgccca

SEQ ID NO: 25303 - DNA, 86 bp, Homo sapiens
cggccgctgggcgcagcgttcgggggttgcacggcccgcggcggcgacgaaaacaacgaccaggacgctcggcgcccctgtccgca

SEQ ID NO: 25304 - DNA, 65 bp, Homo sapiens
ggcgggcggcggggcggggctggggccgggttgggggcgcggcaccagcaccagctgcccgcgcc

SEQ ID NO: 25305 - DNA, 58 bp, Homo sapiens
ctcatcccctgctgtcaggtcctgacccaacaagggcctgggctgctcatggggatga

SEQ ID NO: 25306 - DNA, 61 bp, Homo sapiens
gcggtgcctgctctgcggacttttgtggtgtccccaagtaccgtggtcgcaggtgctgcct

SEQ ID NO: 25307 - DNA, 60 bp, Homo sapiens
tgccaccgccttgtccaagatggcggacctccaccgccagctgcaggagtacctggcgca

SEQ ID NO: 25308 - DNA, 70 bp, Homo sapiens
cccagcggcgagggcgcgaggtcctcacacgggcagcaccttggcgaggccggcgccgcggcccaggcga

SEQ ID NO: 25309 - DNA, 63 bp, Homo sapiens
agacatgttcagcaactagcagagtccccatttcgactccttgacctatgcagtgaggtctat

SEQ ID NO: 25310 - DNA, 78 bp, Homo sapiens
atgctcccatgaccatggcaggtactgtcacaatctgcatggattatgaggctacctgccagggtcatgggagcatta

SEQ ID NO: 25311 - DNA, 78 bp, Homo sapiens
aaggccggagggagggagtcggggtgggagccgtctgagggcagacggggtctctgacagccacctttccccgccagt

SEQ ID NO: 25312 - DNA, 54 bp, Homo sapiens
ggcggacgtggcggcgctcagggaggctcgcccagggcccgtgcgcgttccaga

SEQ ID NO: 25313 - DNA, 78 bp, Homo sapiens
gcggcagcgccccgggcccgcggccccctcccctccggcgaggggagccgctggatggggccggtcggggggcggccc

SEQ ID NO: 25314 - DNA, 68 bp, Homo sapiens
cccgccccttccccctccccctgcggccctgtgtagtcacgcgttgggtggcgtggggaaggggggct

SEQ ID NO: 25315 - DNA, 73 bp, Homo sapiens
tccctcaggtgcccgaggtcgagtggtggtgtgtggttcccacccccagcgccccctcctccggtcaccgccg

SEQ ID NO: 25316 - DNA, 61 bp, Homo sapiens
tgtgaggttgtcatgcctgctattactacagctatgccagcaggcatgacaacctcatact

SEQ ID NO: 25317 - DNA, 51 bp, Homo sapiens
ccctgcgaacccccagcaccatgctcccggctgcgtggcccagcagggcac

SEQ ID NO: 25318 - DNA, 57 bp, Homo sapiens
gcgcttgggaagccgccaccgccgccgctgctgcatggcactaggctcccggcgggg

SEQ ID NO: 25319 - DNA, 59 bp, Homo sapiens
actttcctcagtttggctgtttatgacaattatatattctggtcggactggggaagaag

SEQ ID NO: 25320 - DNA, 80 bp, Homo sapiens
tactgagttgtgaaatactgtggagaatgtgaggaggggtggggtgatcagatcattctgtagaagtaatgtttacactg

SEQ ID NO: 25321 - DNA, 81 bp, Homo sapiens
agcagctggatacagaaatgctcattagttttaagagggttaatccttttaacttttgcatattgatatgccaattatgcc

SEQ ID NO: 25322 - DNA, 71 bp, Homo sapiens
ccgaggcaggcgctgggacgcagcgcccacccggcctcccggcctccgcagccccagcccgcgcctcgcgg

SEQ ID NO: 25323 - DNA, 62 bp, Homo sapiens
actgaggaaggaggtggaggaggcggcgggagtcctccccccctccccgcccgccccgccgc

SEQ ID NO: 25324 - DNA, 89 bp, Homo sapiens
cgatgatgtaagtatatggctgttttaaaatctcacagtgatgcagatatcacttccaaagcttttccatctacttacactcagaatgc

SEQ ID NO: 25325 - DNA, 60 bp, Homo sapiens
agggtttgcctgggactgtcctgtgtcctgggaaacactgaagtcccaggcaaaccagga

SEQ ID NO: 25326 - DNA, 57 bp, Homo sapiens
tggtccctttccgtgtaaacttccggctgaaagggaaggacatggtggtggacatcc

SEQ ID NO: 25327 - DNA, 70 bp, Homo sapiens
tcactagatttggggattgacaccctggagcccttggacagtgtgtcaattcccaaatctagtgataaag

SEQ ID NO: 25328 - DNA, 89 bp, Homo sapiens
ccccctcagtccaggccgagagccagatgggggtcacgtggccgcggggccccccgggcgcagggtcctcggcacagctgacgggtgcg

SEQ ID NO: 25329 - DNA, 61 bp, Homo sapiens
ggggtcggccccgcctggccagccgccccgtctgggagggaggtggggggatcggccccgc

SEQ ID NO: 25330 - DNA, 88 bp, Homo sapiens
tgccatgtgacgggcaaggcggcccctttccccagcgcggccagagggaggagagaaccggggctcgccgcgagccttcgagagcagc

SEQ ID NO: 25331 - DNA, 58 bp, Homo sapiens
cgcacggcccggcgacgggggagttcccgcgagtggcctcgcgcccagaccgtgcggg

SEQ ID NO: 25332 - DNA, 59 bp, Homo sapiens
gcgcttccggcaccggccgaggtgcgggtcgcctccagaggtgcgtggtcgtggcgcga

SEQ ID NO: 25333 - DNA, 79 bp, Homo sapiens
gccgcggcggccgtcgggggccagcagccgtcacagcccgagctgcccgcgccggggctggccctagacaaggcggcca

SEQ ID NO: 25334 - DNA, 62 bp, Homo sapiens
tcgccaccatcccccaccccagggtctggcggagaagccccggggcggggggggcggggggg

SEQ ID NO: 25335 - DNA, 70 bp, Homo sapiens
tgagaggatgaggggaaggatttcttcagaacaatgtcttttgatgaccattcttctttttctctctaga

SEQ ID NO: 25336 - DNA, 79 bp, Homo sapiens
tgcgcattagattctcagaggagcaagaatcctaaagtgaactgtgcatgcgagctccttatgagaatctaatgcctga

SEQ ID NO: 25337 - DNA, 56 bp, Homo sapiens
atcccccacccgcgccggggctgacgcaagaagctcgcggtccgggggcgggaagg

SEQ ID NO: 25338 - DNA, 68 bp, Homo sapiens
tcgccacctctaaccagtgacaactgtcaagatgtaatgaaagtcgtcattggttagaggtggcgaga

SEQ ID NO: 25339 - DNA, 76 bp, Homo sapiens
aacgcctgccacgcgtcggaactcggccgcgggacatccacggggcgcgagtgacacgcgggagggagagcagtgt

SEQ ID NO: 25340 - DNA, 69 bp, Homo sapiens
atacacctgatcccatgagaagtgctatcatatcacagccaacgtggtctcatgggatcaggtgtatat

SEQ ID NO: 25341 - DNA, 86 bp, Homo sapiens
cttgtcaaactctttaaaaattccctgttggcattgtggcatgattgataatgccaggagggagtttttaaagagtttgacaagta

SEQ ID NO: 25342 - DNA, 54 bp, Homo sapiens
tggatctggtatctgtgggggtttctggatacctccacagatagcagatccaca

SEQ ID NO: 25343 - DNA, 64 bp, Homo sapiens
gaggctgaagcatggaggttgcagtgagccgagttcatgcccctgcattccagcttggcctaca

SEQ ID NO: 25344 - DNA, 70 bp, Homo sapiens
ctgctgttggatgaggctgaggtcggagcggctgagttccgctctggcggccgcggggaccagccgcgct

SEQ ID NO: 25345 - DNA, 70 bp, Homo sapiens
atttatgtataggcctttagatcatctgatgttgaatactctttaagtgatctaaaggcctacatataaa

SEQ ID NO: 25346 - DNA, 59 bp, Homo sapiens
acaccagcttcctcttgttgctcttaacatgtggaagccaccagaggaagctggtgtcc

SEQ ID NO: 25347 - DNA, 65 bp, Homo sapiens
ttgccctctgcctcagggtcagagaacagctgccttcagctattctcccccaaaggtatgcagag

SEQ ID NO: 25348 - DNA, 64 bp, Homo sapiens
ccctgggcagcgcctttgttttcccgactccagttacgtttgcggaagtgctgccagcacgggg

SEQ ID NO: 25349 - DNA, 65 bp, Homo sapiens
ccgggcggcaccgcgaggcccactggggcgggcgctcccttttctcgctttggggtctcccgggc

SEQ ID NO: 25350 - DNA, 87 bp, Homo sapiens
ccgccgccgggcgggggcgggggcggccgctgggcccggggctcggccccttcccgccgccccctccgcggaatccggaggacggcc

SEQ ID NO: 25351 - DNA, 82 bp, Homo sapiens
tcaacatgtcatctttcatataaaggttcacttttctcagaagtgaaactaacttctatatgaaagatgacacgtgttgact

SEQ ID NO: 25352 - DNA, 80 bp, Homo sapiens
cacgtgtcatctttcatatagaagttagtttcacttctgagaaaagtgaacctttatatgaaagatgacatgttgactga

SEQ ID NO: 25353 - DNA, 80 bp, Homo sapiens; identical to SEQ ID NO: 25352

SEQ ID NO: 25354 - DNA, 51 bp, Homo sapiens
tgggaggcaatacatgaacctggtacaaaggttcatgtattgcctcccagt

SEQ ID NO: 25355 - DNA, 78 bp, Homo sapiens
cgcgggccacgcgcggcggcgacttgggctgggcggtcgccctgccccaccgcccttcggcgctcgcaggtccgctcc

SEQ ID NO: 25356 - DNA, 63 bp, Homo sapiens
agggagccagtaatgaggcagagggaacaagttccatcccatgcctcagaggtggctctcaca

SEQ ID NO: 25357 - DNA, 76 bp, Homo sapiens
caagcttcctgatcgagggagagccatcagacctgcctgggaggggatgtggctttggcttttcaggaagcccttc

SEQ ID NO: 25358 - DNA, 60 bp, Homo sapiens
tcggcacttaaaatccataccgtggcttctctctatggtatggagtgaaacgtgccaaca

SEQ ID NO: 25359 - DNA, 71 bp, Homo sapiens
cgaggctaggcgagccgggaaagggggcgccgcccagccccgagccccgcgccccgtgccccgagcccgga

SEQ ID NO: 25360 - DNA, 53 bp, Homo sapiens
cggcgaccagcccgagcccagccgtcccgggagctggcgcgagtgtcgccacg

SEQ ID NO: 25361 - DNA, 56 bp, Homo sapiens
accccgcctccgcctgggcacggggcagggacccgcgcgaggcggtgccggggagg

SEQ ID NO: 25362 - DNA, 56 bp, Homo sapiens; identical to SEQ ID NO: 25361

SEQ ID NO: 25363 - DNA, 54 bp, Homo sapiens
cccgggcggggcgggagagggcagccagcctgcggccgtgagtccgctgtggtc

SEQ ID NO: 25364 - DNA, 75 bp, Homo sapiens
agaccgcggcagggttccgtccccccgagccgcacggagctgcgggcagcgggcggactgttaaaccgcggcggc

SEQ ID NO: 25365 - DNA, 66 bp, Homo sapiens
atctgtatctacctaggtagagcaataatagatttataatagatctaccagggtagatacagatgt

SEQ ID NO: 25366 - DNA, 72 bp, Homo sapiens
cggcaggaagggaggcgacgccccctggagcgcggcaggaacccggcccggcccgcctcccagtccgcctag

SEQ ID NO: 25367 - DNA, 58 bp, Homo sapiens
agcccctccctccaccaacagccctctaggtgtgctgaagcgggggggggggggccca

SEQ ID NO: 25368 - DNA, 64 bp, Homo sapiens
ccccgcgacgagcccctcgcacaaaccggacctgagcgttttgttcgttcggctcgcgtgaggc

SEQ ID NO: 25369 - DNA, 90 bp, Homo sapiens; identical to SEQ ID NO: 19410

SEQ ID NO: 25370 - DNA, 54 bp, Homo sapiens
tggggaggggttactgctcctgcaacagcagcctctagtagctcctctcccgcc

SEQ ID NO: 25371 - DNA, 64 bp, Homo sapiens
tgccgagcgcaagaaccctgcgcagcccagagcagctgctggaggggaatcgaggcgcggctcc

SEQ ID NO: 25372 - DNA, 79 bp, Homo sapiens
aggtgggatgagagagggagggctcaagggaaacaaggcgcaccgtcctctgagctccttctctacccatcccaccaca

SEQ ID NO: 25373 - DNA, 75 bp, Homo sapiens
ggtgggatgggtagagaaggagctcagaggacggtgcgccttgtttcccttgagccctccctctctcatcccacc

SEQ ID NO: 25374 - DNA, 66 bp, Homo sapiens
cgctgccatcgccggggtccggggagggcgccccggtcttcctcacggggcctcgatcccagtggg

SEQ ID NO: 25375 - DNA, 62 bp, Homo sapiens
gaagccaggctgttaggctagtggtcagagacacagacactagcctgacagcctcgcttcca

SEQ ID NO: 25376 - DNA, 61 bp, Homo sapiens
gagacagaattttatattttcctctaggttgtctaggggacaatataagattctgtcccct

SEQ ID NO: 25377 - DNA, 83 bp, Homo sapiens
gcggagaggggcgggcgcggggcgggctcggcccggaatgtagagacccgggcgggagcctcccggcggcggctgcccggctg

SEQ ID NO: 25378 - DNA, 71 bp, Homo sapiens
tcccagccactgagcatgcccagcgcctcgactgctgagtgcccagccagcatcctgcagtgcctgggagc

SEQ ID NO: 25379 - DNA, 59 bp, Homo sapiens
tgcagaccgcgtgcgccggcagtggctctaagggggccgcgagggcacagcggggcagg

SEQ ID NO: 25380 - DNA, 55 bp, Homo sapiens
ctgctgtcctttgaaataaataaaacattttatttatttcaaaggacagctggaa

SEQ ID NO: 25381 - DNA, 67 bp, Homo sapiens
aggcagtgcccgaaggccagagagttggaattcgggaccttctctggaaagggcttggctgccacaa

SEQ ID NO: 25382 - DNA, 59 bp, Homo sapiens
cagggtcagcattcgtgggtctccatggtcctagcggtgcccacgttatctgcccttgc

SEQ ID NO: 25383 - DNA, 69 bp, Homo sapiens
tgggcagggaggcacaggatgacccggatgagttaccaccctgtcctgtgtctccatttccccttcagc

SEQ ID NO: 25384 - DNA, 74 bp, Homo sapiens
cgcctagtgctgcacgaccccctcgggaccgacccggggtctggcctctggggggctccgcggcgcttcgcccg

SEQ ID NO: 25385 - DNA, 55 bp, Homo sapiens
gcctggcacagcggcggcagcgcggacgtgggttggcggccgcggagacaggctc

SEQ ID NO: 25386 - DNA, 58 bp, Homo sapiens
gggcagcagcatggggctctcagagggtggagggctagggcctgatgctgctgctgtg

SEQ ID NO: 25387 - DNA, 57 bp, Homo sapiens
agagcagagcagagccctggagcggacctcacccccctgggcctcgcgctgatcagc

SEQ ID NO: 25388 - DNA, 57 bp, Homo sapiens
cccggcccccagtgacgcccaggctcgcctcctgcctgggttccagggggctgcacc

SEQ ID NO: 25389 - DNA, 59 bp, Homo sapiens
ccgcccccgcccccgcccaggcgcgggaccaccctccgcccgccgaggcgggggcccag

SEQ ID NO: 25390 - DNA, 57 bp, Homo sapiens
cgagctggctgatggtaccctgcctggcagtaggggccagcaaggtgccagtgggcc

SEQ ID NO: 25391 - DNA, 68 bp, Homo sapiens
aggtgctctcatggcaggatgcactggggatggaaagcagctgccacctgtcatggacatgcacctcc

SEQ ID NO: 25392 - DNA, 58 bp, Homo sapiens
gcgcccggcctcctgctggagctggcttcagagccttgcccgtggacggtcaccttgt

SEQ ID NO: 25393 - DNA, 60 bp, Homo sapiens
cgccagtgggccggacggggcctggccaggcaggagcaggccccgtgcagcccgcgccgc

SEQ ID NO: 25394 - DNA, 64 bp, Homo sapiens
gggctgcggggcgggcgggcgggtccgggagcgcgctgccggctcaccgcccttcccgcccgcg

SEQ ID NO: 25395 - DNA, 53 bp, Homo sapiens
ccgcggggcagcggagggcgccggcactccggtccccgccgctccccgtcccc

SEQ ID NO: 25396 - DNA, 81 bp, Homo sapiens
tcccagaggggagaagtttccaacggtagtcattgctggagggcacagaactactgctggaatcttctcccctttgggaca

SEQ ID NO: 25397 - DNA, 60 bp, Homo sapiens
ctgaggctggccctgggtggcccagatgcaccagggggcccactgggggcagacctggca

SEQ ID NO: 25398 - DNA, 51 bp, Homo sapiens
agtcctctgggtggttatgagcctccaggcgcatgctgtccagtggacaga

SEQ ID NO: 25399 - DNA, 51 bp, Homo sapiens; identical to SEQ ID NO: 25398

SEQ ID NO: 25400 - DNA, 54 bp, Homo sapiens
gccccgggccatctggacggcgagcgcgagcgcgtttgaagtggttggggggct

SEQ ID NO: 25401 - DNA, 62 bp, Homo sapiens
agctccaggcagtcagctccacgtgccttcctgccactggggctgccactggctggagcctc

SEQ ID NO: 25402 - DNA, 75 bp, Homo sapiens
cgggcggcggcggccggctctagccctgctccggcgctccgcgccgcatctcctcagcctgcgccgccacccgcc

SEQ ID NO: 25403 - DNA, 93 bp, Homo sapiens
acgggtgtgttcccgggggccgtgggggcacccagcaggcactcaaccctcaggctgcgcctcctggtcccccgggctagggcacacgcttcc

SEQ ID NO: 25404 - DNA, 56 bp, Homo sapiens
gccgggaacccgggcctggccgggctttgggctccggaccctggtcttcccgacgc

SEQ ID NO: 25405 - DNA, 60 bp, Homo sapiens
gcaccaacggtggaggtacgggcgaggcggccccgcggcgcccagcttctgccggtccca

SEQ ID NO: 25406 - DNA, 57 bp, Homo sapiens
cggaggagcagctggcgcgcgcgggagtcacgctgtgcgtcaacgtctcccgccagc

SEQ ID NO: 25407 - DNA, 57 bp, Homo sapiens
tgggggcggcccaggggctggggtgcaacagcggcccagccctgacctgccccctgc

SEQ ID NO: 25408 - DNA, 50 bp, Homo sapiens
ccgggggcggcggagcccagggctatcccggcctccgctcatacccggag

SEQ ID NO: 25409 - DNA, 68 bp, Homo sapiens
cgcgggacgcggagcccccgacggcgcggccagcgggcgcgcccgcgctccccgcaccccgcctggcc

SEQ ID NO: 25410 - DNA, 63 bp, Homo sapiens
tggtggcagaagttccggcttcgctccaagaagaggaaggcgggagcttctgcaggggctagc

SEQ ID NO: 25411 - DNA, 65 bp, Homo sapiens
gcgggcagttgggagcaggcgacgccgacgcgagtctggcggctgctgcttgcgactgcggaggc

SEQ ID NO: 25412 - DNA, 63 bp, Homo sapiens
cgggcccgctgcgggcgcctgcgcctccatcttgccgtacggcgcggacgccgcgggccggcc

SEQ ID NO: 25413 - DNA, 51 bp, Homo sapiens
cgacgcgagccccggggcgccctgcgggcggcatggggtcgtgtcgtggga

SEQ ID NO: 25414 - DNA, 61 bp, Homo sapiens
tggcccaggggtcgctgacaggtgcggaggggagacgcccacctgggtgccctgggccgca

SEQ ID NO: 25415 - DNA, 51 bp, Homo sapiens
tcggcggctctgggcctgcggcgggcgctgcgggttggagctcgggacgtg

SEQ ID NO: 25416 - DNA, 65 bp, Homo sapiens
ggagggggacggcgctgcagctcgtcacgtgaccgcgtggaacacgcgcgcgcgtccgcgggatc

SEQ ID NO: 25417 - DNA, 56 bp, Homo sapiens
cgtgagccaccccgccctgccaacaacccaagtttgcctggcgcagtggctctgcc

SEQ ID NO: 25418 - DNA, 58 bp, Homo sapiens
ctggctgccctggagccccacgtgtacgagtggacggccgggcagcagggcagcgtca

SEQ ID NO: 25419 - DNA, 71 bp, Homo sapiens
gggcggcgggatccacagcgtcgagccgctggggacgggttaggagcgcgccctgcgagcccggcgcctgc

SEQ ID NO: 25420 - DNA, 67 bp, Homo sapiens
gacgcgccgaggtactaggcagagccgtggaaccgccgccaggtcgctgttggtccacgccgcccgt

SEQ ID NO: 25421 - DNA, 59 bp, Homo sapiens
gcagcgcccgaagtctcgctgacgccgcaagcgggcgaggcagggtgaaactggcacgg

SEQ ID NO: 25422 - DNA, 68 bp, Homo sapiens
ctctgcagctgcgcgggcgggcgtggttgccggggacgcgcggcccccggtcgggcactgcaggcggc

SEQ ID NO: 25423 - DNA, 66 bp, Homo sapiens
gcgctgagccgcctgggcgcggggaccccgtgcaggccccgggcccctctggtgctgccagcgcgc

SEQ ID NO: 25424 - DNA, 55 bp, Homo sapiens
gctggggcggcaaggtgacaggtgtgcagccctgtagcctttcctgctccagcct

SEQ ID NO: 25425 - DNA, 52 bp, Homo sapiens
gaagttccaggagagggaggtgccatgccacaggccctcacctggggctctg

SEQ ID NO: 25426 - DNA, 70 bp, Homo sapiens
cgctccgcctctgggcggggacccgccgagctcctccccgggcccgccccgccgggagccgggaagctag

SEQ ID NO: 25427 - DNA, 57 bp, Homo sapiens
cgcttctccaggcggtggcaacggccgcaaggctgcagcccccctcggagaagctca

SEQ ID NO: 25428 - DNA, 53 bp, Homo sapiens
gagcgctggcgaggcacggacggcgggcgcccggtacctctgcccgcggtcct

SEQ ID NO: 25429 - DNA, 53 bp, Homo sapiens
ccaagggcaaggtgccagcaaatctcatgtctgctgagggcccacttcttggt

SEQ ID NO: 25430 - DNA, 71 bp, Homo sapiens
tcttgtgggacagaaactgaaaaataaatgtatgcacaagaattatttttcagtttctatcccacaagggt

SEQ ID NO: 25431 - DNA, 88 bp, Homo sapiens
ggttgtcgggatccgcggcagcagcggctgcttgagatctgtttctggggcctctggcggtggcggcctggggcggcgcgacggctgg

SEQ ID NO: 25432 - DNA, 59 bp, Homo sapiens
ctgaggatacttaactatggaattttttaaaaaacattctagagctagggttggttata

SEQ ID NO: 25433 - DNA, 64 bp, Homo sapiens
tccctgtgtgcagtccttcaacccttctgtgccaggggaagagggacggcgcagggggccccct

SEQ ID NO: 25434 - DNA, 69 bp, Homo sapiens
cgcaggtcccggccgctctttatcccgagtcgcgggcggctgcggagtcgcgggcggtcgggcggcggc

SEQ ID NO: 25435 - DNA, 82 bp, Homo sapiens
agcctcagctttgccagatccttgcacgggtcatggaggaggctcctggacccgtgcaaggatctggcaaagctgaggtcca

SEQ ID NO: 25436 - DNA, 54 bp, Homo sapiens
gagtccggcccagggcaggtgggatgcacccatgtcgtgggggctggtgggctc

SEQ ID NO: 25437 - DNA, 84 bp, Homo sapiens
tgagtggtggccaggccctgttgggggaagagagttgggagtctgatggttaattcccccagtgctggtcaggccccatgttgg

SEQ ID NO: 25438 - DNA, 60 bp, Homo sapiens
gtcgcgccgtgcccgggcccggggcttgacggctccagcctggcgcgtggggccctaccg

SEQ ID NO: 25439 - DNA, 59 bp, Homo sapiens
tgctcacctggtgcagggcacagcatttgtgacagttccctgttctctgtgtttgcagc

SEQ ID NO: 25440 - DNA, 77 bp, Homo sapiens
ccggcggtacgggggtggtgccgcgctcctggccccgcgcgggcggacggcggaggcgcctcccaggtgagccggcc

SEQ ID NO: 25441 - DNA, 53 bp, Homo sapiens
agcgagggttccgccggccaccgcggtggtggccgagcgcggctcgtcgccta

SEQ ID NO: 25442 - DNA, 53 bp, Homo sapiens; identical to SEQ ID NO: 25441

SEQ ID NO: 25443 - DNA, 60 bp, Homo sapiens
cccgggccggcgcctggctccagcaagtctgggccgcctccccgcgccgccccgcggggg

SEQ ID NO: 25444 - DNA, 74 bp, Homo sapiens
ggcgaaggtcgggagggtgggggcggggccggctgccttgaccccgccccgcgccggccttgaccccgcccacc

SEQ ID NO: 25445 - DNA, 65 bp, Homo sapiens
cgcggggcccgccccctaccttggtcatgccattgcccatgatcccgggggcggcggtccgggtg

SEQ ID NO: 25446 - DNA, 73 bp, Homo sapiens
tccccctccccctccgcggccgcccgggccgggcccgcggggtgagggggccgcgagggagggaggcgggagc

SEQ ID NO: 25447 - DNA, 55 bp, Homo sapiens
agacccactggctatgtgacctggccctgcaggtccaactgtcaatgggtctaac

SEQ ID NO: 25448 - DNA, 71 bp, Homo sapiens
cggctgctctcgcgcttccggtccccggggaaggctccccgcgaagccggccccgccgaggagcagccgcg

SEQ ID NO: 25449 - DNA, 60 bp, Homo sapiens
tggagggaccagggtttccagagatgctcaccttgtctctgcagccctggagccccctgt

SEQ ID NO: 25450 - DNA, 60 bp, Homo sapiens; identical to SEQ ID NO: 25449

SEQ ID NO: 25451 - DNA, 89 bp, Homo sapiens
cgcggcgcactgggtgtgggccggggcgcctgcggtgtggcgaagagcagcaggtcagggtcgcaggggccggcggcgggcgccgcggg

SEQ ID NO: 25452 - DNA, 78 bp, Homo sapiens
gcggcggcggcggcgcgggcccatggcggcaggcctcggcgagggctcgatcccgctccgcccccggccgccgctgcc

SEQ ID NO: 25453 - DNA, 65 bp, Homo sapiens
cgccggagccgacccgagccgagccgagccgagccgagccggagcgggcggcgaaggccggcgcg

SEQ ID NO: 25454 - DNA, 50 bp, Homo sapiens
ggtagaggtgaggatgggccagggctcacccaaccccacctcggccccca

SEQ ID NO: 25455 - DNA, 77 bp, Homo sapiens
gcctgagggacggaggccgggatacttgggaaaggatccgccggccttgaactcccgcctccgccgcccctaggcct

SEQ ID NO: 25456 - DNA, 71 bp, Homo sapiens
tccgggaagccgttcgggctggggctgtcggccgcggggcggaggcactcgcgcggggggtaattcggggt

SEQ ID NO: 25457 - DNA, 75 bp, Homo sapiens
ggcggtccaggcgccgccgccgctgggagctgggcacctggcctgggcggtgggtggcggcggcgggggtgtccc

SEQ ID NO: 25458 - DNA, 53 bp, Homo sapiens
tggcgcccgacgcgcggccagcccccgcccccgccccggcctcggagcccagc

SEQ ID NO: 25459 - DNA, 69 bp, Homo sapiens
tgtggtggctcgcatctgtggtcctagtgactagctgtggaccacagatgggagccaccacacctgact

SEQ ID NO: 25460 - DNA, 69 bp, Homo sapiens; identical to SEQ ID NO: 25459

SEQ ID NO: 25461 - DNA, 60 bp, Homo sapiens
tggtggctcccatctgtggtccacagctagtcactaggaccacagatgcgagccaccaca

SEQ ID NO: 25462 - DNA, 75 bp, Homo sapiens
cggaagtcagcccgcggctcggactccggcgggacctgctcggaggaatggcgccgccgggtgaggagttgcgcg

SEQ ID NO: 25463 - DNA, 58 bp, Homo sapiens
gctgcgcccgcgcccgcctctccagcctacgctggatgggcgggcggggcagggggtg

SEQ ID NO: 25464 - DNA, 55 bp, Homo sapiens
gcagcgactggcatctgagttccctgctgagaagctcgcagccgtggggctgcag

SEQ ID NO: 25465 - DNA, 82 bp, Homo sapiens
cggagggcggcggcggcggcggcggcggcagcggcgtcagagcagctacgcgaagctggcgcggcgcccccacccgtgcgca

SEQ ID NO: 25466 - DNA, 64 bp, Homo sapiens
agagctactcggagcaccgtcccgggccggcctcggccccgaggctccgggggctcaggattcc

SEQ ID NO: 25467 - DNA, 77 bp, Homo sapiens
aagcgcgggcgggcggcgggcgggaagagggagggatgggcccgcgcgcgtcgccgctcccacctgcccgcacccgc

SEQ ID NO: 25468 - DNA, 58 bp, Homo sapiens
cctgtggtgtgaggcgcgtgttcgggctcttgccgtccccgcacccgcaccgcggtta

SEQ ID NO: 25469 - DNA, 64 bp, Homo sapiens
cagccaccgtgcctggcctagagttttatataaatagtcttataggccgggcatggtggctcac

SEQ ID NO: 25470 - DNA, 59 bp, Homo sapiens
gggcccgcccgccttgggtcgcgtcgtctcccgacgcctcctgcctgggccgggcctgg

SEQ ID NO: 25471 - DNA, 78 bp, Homo sapiens
ccaccgccccgggatctccttgcgctcggtcctctacgtggagtcacctatgcagaggaattccacggggcgggggcg

SEQ ID NO: 25472 - DNA, 76 bp, Homo sapiens
ccccgcctcccacgccctggatcgtcacttccggcgcgagaggccgggcaggccgggcagggagtgcgggtcggtt

SEQ ID NO: 25473 - DNA, 60 bp, Homo sapiens
aaacctagtcagattagttctccctggtgagccttggggacaactaatctgactgggttt

SEQ ID NO: 25474 - DNA, 74 bp, Homo sapiens
actcaaccctgtcacctaggcactaatatgtaaatgtagataatagtgcctaagtgatagggttgcttgagtgt

SEQ ID NO: 25475 - DNA, 75 bp, Homo sapiens
ggtaggcggaagtagccgcaggcatggcggcggctatgccgcttgctctgctcgtcctgttgctcctggggcccg

SEQ ID NO: 25476 - DNA, 75 bp, Homo sapiens; identical to SEQ ID NO: 25475

SEQ ID NO: 25477 - DNA, 68 bp, Homo sapiens
tggtgaggtgggggcagggggaggggcagggaagcagaggccctgacccactgtctgtgccttccagg

SEQ ID NO: 25478 - DNA, 84 bp, Homo sapiens
gccgccattgcctcgtgcccgcgccggtcggttggtggcgcctttgtcctacggcgggcaggtgggccgacgcggaggcggcag

SEQ ID NO: 25479 - DNA, 66 bp, Homo sapiens
gcagatcccgggtggggagcccgcttcccttctccagccccggccccccagcctctgggagtgcgc

SEQ ID NO: 25480 - DNA, 71 bp, Homo sapiens
ctcctacggtatgtcctagatgagtggtgcaccgggcgcgtagttattcctgggaaaaagacgcaggagcg

SEQ ID NO: 25481 - DNA, 63 bp, Homo sapiens
cgcccgccgcgccgggagcccggcccgccgctgagcccggcccgccggcgcgccccgtccggg

SEQ ID NO: 25482 - DNA, 68 bp, Homo sapiens
atggagaggaaagggcgggcaatccgcaggctcgcgttaggccgcgcctcagttgccctcagccctca

SEQ ID NO: 25483 - DNA, 55 bp, Homo sapiens
ggctagagcccgacggggcccggctccggcggcagccgcgcctctcgcttgcttc

SEQ ID NO: 25484 - DNA, 72 bp, Homo sapiens
ggcctcctcctcatcggccgccgttgcgcggcgcagagcggcagcaagatggcggcgcaacagcgggactgc

SEQ ID NO: 25485 - DNA, 71 bp, Homo sapiens
ttcgctggcgcagcgcgggtcgtccccggtgctggggctgtccggggcgggacgtcgagcgaagcgaggcc

SEQ ID NO: 25486 - DNA, 73 bp, Homo sapiens
ctccttccgcttgcagtccgcgggctcgaagcccggctccgccttgagctcggcgggcggcggcggcggcggg

SEQ ID NO: 25487 - DNA, 51 bp, Homo sapiens
ggagctgaactgctaactggaatggtcacccagttctcaattcaactcaga

SEQ ID NO: 25488 - DNA, 51 bp, Homo sapiens; identical to SEQ ID NO: 25487

SEQ ID NO: 25489 - DNA, 58 bp, Homo sapiens
acccccaaggattgtaagctctgcatcaggtaccagagcgtgcaatctctgggggtca

SEQ ID NO: 25490 - DNA, 58 bp, Homo sapiens
acccccagagattgcacgctctggtacctgatgcagagcttacaatccttgggggtca

SEQ ID NO: 25491 - DNA, 58 bp, Homo sapiens; identical to SEQ ID NO: 25490

SEQ ID NO: 25492 - DNA, 61 bp, Homo sapiens
cgcgccccgtgactccctcgggtgcccaaaaatctgtccccgggagtcttggggcgcctgc

SEQ ID NO: 25493 - DNA, 62 bp, Homo sapiens
aaggggaggagagtggttgctgccctcagccggcttgaggacagagcctgtccctctcatga

SEQ ID NO: 25494 - DNA, 62 bp, Homo sapiens
ctctggacctgctctcccctggttagtgtttcggatggacaggggtgggaggttcagcaggc

SEQ ID NO: 25495 - DNA, 59 bp, Homo sapiens
cccgccgcgccgggctccgtccttccagcactggggcggaggccgcgggcaggaaggtg

SEQ ID NO: 25496 - DNA, 86 bp, Homo sapiens
gtcgggatcggctggggcgtcaggggccgccccggagtcgggatcggctggggcggcaggggctgccccggagtcgggatcggctg

SEQ ID NO: 25497 - DNA, 56 bp, Homo sapiens
taagagcggcggcggcggcagcggcggcagcagctcccgcagctcctgctctggtc

SEQ ID NO: 25498 - DNA, 56 bp, Homo sapiens
cactgccagtggagatgggcgtcactactgctaccctcatttcacctgcgctgtgg

SEQ ID NO: 25499 - DNA, 58 bp, Homo sapiens
ctccgggatgggcactctgctcatgaacaagattagagaggagtacccggaccggatc

SEQ ID NO: 25500 - DNA, 58 bp, Homo sapiens; identical to SEQ ID NO: 25499

SEQ ID NO: 25501 - DNA, 53 bp, Homo sapiens
gccgaggcgggcgcggggcggcgacggggcctcgctctttgtctcggctcgct

SEQ ID NO: 25502 - DNA, 54 bp, Homo sapiens
cgggagtcccggggctgcccgggaacacccggcgcccagggcctccgccactcc

SEQ ID NO: 25503 - DNA, 76 bp, Homo sapiens
gagccccagtcgcgcgccccttcttggttcgctcggtgcccgcgcaggcccctcgggcggtggcgaggaggcgccc

SEQ ID NO: 25504 - DNA, 65 bp, Homo sapiens
gccgggagtcgcgggtgcgcgcgggccgtgagtgtgcgcttttgagagtcgcggcggaaggagcc

SEQ ID NO: 25505 - DNA, 55 bp, Homo sapiens
tgggctccggcggcctcaggctgaggagggagcagcaagccgctcggagcccagc

SEQ ID NO: 25506 - DNA, 56 bp, Homo sapiens
aaggcccgcctttgtggctgcttccccacagacacagcggcagaggagtcccctgc

SEQ ID NO: 25507 - DNA, 67 bp, Homo sapiens
gccccgggcgggtgcgcggctggggggtgcggactgcccgggccgaaggccgacgaatccgcggtgg

SEQ ID NO: 25508 - DNA, 71 bp, Homo sapiens; identical to SEQ ID NO: 18602

SEQ ID NO: 25509 - DNA, 77 bp, Homo sapiens
ctgcacccgggcggggcggggatggcggcgggggctgcctccctcctccgccgccaccccccactgctgggcgcgcc

SEQ ID NO: 25510 - DNA, 63 bp, Homo sapiens
cagcgacccgcggttaacgcttccccagagcttgggctgcgcggcggccgggagtcggaggca

SEQ ID NO: 25511 - DNA, 77 bp, Homo sapiens
ccgcggcgttcggggaaatggctgcgagaccctagaggcctgcggcctgcggtaagtggcgtcccgggcgccgggta

SEQ ID NO: 25512 - DNA, 55 bp, Homo sapiens
cacagggcagcctggcacctgctgagcccttgctggggccatgctgtcctgagcc

SEQ ID NO: 25513 - DNA, 58 bp, Homo sapiens
tcggggttcccgcgcccttctccgcccagggcagcagcgcgcggggcccccgggagcc

SEQ ID NO: 25514 - DNA, 51 bp, Homo sapiens
ctctgacccctttgggaacctccagcctgggtctagggggtggtgagaggg

SEQ ID NO: 25515 - DNA, 55 bp, Homo sapiens
tctgagggttgggaaggcagcgcctgcagccctcaccttcctgccctcaggctgc

SEQ ID NO: 25516 - DNA, 83 bp, Homo sapiens
ggcgtctggagtgcaccgtcccctccccaacccgacggcagagggcagcttgggctggggcgggggcgggctccaggaggggc

SEQ ID NO: 25517 - DNA, 56 bp, Homo sapiens
aggggcttccttgggaccagtgcaaggaagttctgctgtccctgggaagtctcaga

SEQ ID NO: 25518 - DNA, 62 bp, Homo sapiens
cggcgcccggccggccggccatggagcgccccccgccccgcgccgccggccgggaccccagt

SEQ ID NO: 25519 - DNA, 85 bp, Homo sapiens
ccgcccccggagcccgcgccgcagctgggagcgccgatggcccccgggagggcgcccccgcggggcggggcgtggcggggcggcc

SEQ ID NO: 25520 - DNA, 71 bp, Homo sapiens
gaggtggagggtgggtcttggagccggtgcgagctccctgcgctcaccggagtcctcaccctgcaccccac

SEQ ID NO: 25521 - DNA, 64 bp, Homo sapiens
cggggccagggcagggctccgtggcgatggtgccgggtcaccgatgctcaccctgtccccagcc

SEQ ID NO: 25522 - DNA, 75 bp, Homo sapiens
tgtgtgtgtgcacgtatgcatatgcctcggccacagccctgtgtgtgtgcgtgtgtatgcgtgcacgtatgcata

SEQ ID NO: 25523 - DNA, 68 bp, Homo sapiens
cggcctgcagcgtccccgacgtgctccgccactatcgcgccatcatcttcgaggatctgcaggccgcc

SEQ ID NO: 25524 - DNA, 59 bp, Homo sapiens
gcggcgggagcccttggggttcgagtcccgtgcgccggctcccgaagctcccgcccagc

SEQ ID NO: 25525 - DNA, 62 bp, Homo sapiens
ggggtgatggcggcgcagggcgggccccactcccctgggctgcctgcgtccgcccgccccgc

SEQ ID NO: 25526 - DNA, 76 bp, Homo sapiens
ccccccgagcggctcaccggcttcacgtccgttggtggccccgcctgggaccgaacccggcaccgcctcgtggggc

SEQ ID NO: 25527 - DNA, 180 bp, Homo sapiens
cgcgactgcggcggcggtggtggggggagccgcggggatcgccgagggccggtcggccgccccgggtgccgcgcggtgccgccggcggcggtgaggccccgcgcgtgtgtcccggctgcggtcggccgcgctcgaggggtccccgtggcgtccccttccccgccggccgcctttctcgcg

SEQ ID NO: 25528 - DNA, 61 bp, Homo sapiens
cgcgcgtgcgcccgagcgcggcccggtggtccctcccggacaggcgttcgtgcgacgtgtg

SEQ ID NO: 25529 - DNA, 62 bp, Homo sapiens
cccgggtcggggggtggggcccgggccggggcctcggccccggtcgcggtcccccgtcccgg

SEQ ID NO: 25530 - DNA, 62 bp, Homo sapiens; identical to SEQ ID NO: 25529

SEQ ID NO: 25531 - DNA, 57 bp, Homo sapiens
cgcccgccggcggggctcggagccgggcttcggccgggccccgggccctcgaccggg

SEQ ID NO: 25532 - DNA, 57 bp, Homo sapiens; identical to SEQ ID NO: 25531

SEQ ID NO: 25533 - DNA, 75 bp, Homo sapiens
gcaccgcggtccgcctctcgctcgccgcccggacgtcggggccgccccgcggggcgggcggagcgccgtccccgc

SEQ ID NO: 25534 - DNA, 73 bp, Homo sapiens
gggggcgggtggttggggcgtccggttcgccgcgccccgccccggccccaccggtcccggccgccgcccccgc

SEQ ID NO: 25535 - DNA, 88 bp, Homo sapiens
ccggggaggtggagcgggaggttgtcccaggccctggctgcagagctcttgatgtcacgcctgacaccctccatccaccgcctcgggg

SEQ ID NO: 25536 - DNA, 89 bp, Homo sapiens
ggggaggggagggaggaggactcgcggagggaggaggacaacgccattccgggcggccgctccctccgtcccctctctcccttccccaa

SEQ ID NO: 25537 - DNA, 70 bp, Homo sapiens
gagtccaagcaatacattcagtaactaatctaagcatttgcagccactgaatgtatcacctggacttatc

SEQ ID NO: 25538 - DNA, 56 bp, Homo sapiens
tggctcggccgtcccgccggcccttctccgggagggttggcgcggtcagggccgcg

SEQ ID NO: 25539 - DNA, 60 bp, Homo sapiens
acattctccccgatctcgatctcaagaaagacgggatcgagaaaaagagagagaacgtcg

SEQ ID NO: 25540 - DNA, 61 bp, Homo sapiens
gttcgcagtgccgggagcccgcaaagggctaagaaagaagcgcgggcgggcgtgtggggtt

SEQ ID NO: 25541 - DNA, 80 bp, Homo sapiens
ctggctgtgggttccttatctgttcacaatcccgagacgaaagacaatattaggagcagataatggacccacaaccagga

SEQ ID NO: 25542 - DNA, 61 bp, Homo sapiens
gggattccggactgtgagcggctgttagtgcgtcgcagctgctggcgatccggcgaccctc

SEQ ID NO: 25543 - DNA, 64 bp, Homo sapiens
cgctctgggaggccggctgcgtggggtccccgcgctgcagccgcagaggccccccagggccgcg

SEQ ID NO: 25544 - DNA, 66 bp, Homo sapiens
ttagcatctggcactatggactctcaaatgttagcttctggcaccatggatgctcagatgttagcg

SEQ ID NO: 25545 - DNA, 57 bp, Homo sapiens
aactcgatgcaattcactttgtggaaccaagccacaaagtgaaaagcatcgaattgc

SEQ ID NO: 25546 - DNA, 56 bp, Homo sapiens
gcgccgggatcggggtcggggcccgctcggtccgccccgccccccgcccggcgggc

SEQ ID NO: 25547 - DNA, 63 bp, Homo sapiens
agttcttgctcagagtttcacggaaactcactgaatttgcatgaaactctgagcaagaactcc

SEQ ID NO: 25548 - DNA, 63 bp, Homo sapiens; identical to SEQ ID NO: 25547

SEQ ID NO: 25549 - DNA, 70 bp, Homo sapiens
gccctctgcctcccaaccttcccataaactgagtcacgaggagagctgggaagggggatgcagaggggag

SEQ ID NO: 25550 - DNA, 69 bp, Homo sapiens
gcgcctgagaagaggggacgccagcccggtcaggcctcggcgcggcctacacgctccgctcgctcgctc

SEQ ID NO: 25551 - DNA, 52 bp, Homo sapiens
gcgcgacgccgggtggcccagcagcgggcgggtgccgggggcggaagcgcgg

SEQ ID NO: 25552 - DNA, 54 bp, Homo sapiens
tctggtggaactctgagaatttctggattgaagttctcagagttccaccagatc

SEQ ID NO: 25553 - DNA, 58 bp, Homo sapiens
ctcgcggcgcagggggacgggggagggcgggcctgcccggagccgcgcgccgaacgga

SEQ ID NO: 25554 - DNA, 51 bp, Homo sapiens
tgtggcgagggagtctgtagacagaagacattgccagctcccagccccacc

SEQ ID NO: 25555 - DNA, 71 bp, Homo sapiens
gccggagcagtaggcacccgagcagcgccagcggccgagcgggcggcttcctggcctgggcgctccggtgg

SEQ ID NO: 25556 - DNA, 66 bp, Homo sapiens
agcagcactgctgtcctagccacgccaggcgccagtgtggcctggtaaaggcctcgtgcattctgt

SEQ ID NO: 25557 - DNA, 79 bp, Homo sapiens
cctgtgcgcatgggcggaaccagcgagcgcgcgcctgcgcctgcgcctgcgcctcgctggggctgcggtgggtcgggat

SEQ ID NO: 25558 - DNA, 56 bp, Homo sapiens
ctcggcctgtgggcactgagcatacagtaggtgctcagtaaatgcttgcaggccga

SEQ ID NO: 25559 - DNA, 57 bp, Homo sapiens
gagcctcgggcgcggcgggagcgcagttagagccgatctcccgcgccccgaggttgc

SEQ ID NO: 25560 - DNA, 61 bp, Homo sapiens
tggcgccggccctcgggaggcaccgggtccccgggtcgcttcagaaccaggaagggccagg

SEQ ID NO: 25561 - DNA, 73 bp, Homo sapiens
ggaggttgcgcctcggtggcgccgcgctgctcctgctgctcatcccggtggccgccgcgcaggagcctcccgg

SEQ ID NO: 25562 - DNA, 84 bp, Homo sapiens
gtcccggacggcggtcccaagcgctgctcacgctgctcttaagtgagccctggacgaggcgcggtgggccctcatagtccgcgc

SEQ ID NO: 25563 - DNA, 85 bp, Homo sapiens
tccccgcgtggaggtcccgggaggtctggccccctgcagggcacccatgctggggcagtggatcccgagatgctgagctggggca

SEQ ID NO: 25564 - DNA, 77 bp, Homo sapiens
ggcgggagggctggacggcgggggcggggcggaggagggggtccgtagacggggtcggcgccgggtgctctcgcccc

SEQ ID NO: 25565 - DNA, 75 bp, Homo sapiens
cgcgctacaggcttcgtgctgctgggcctgggtggcgtgctacgggcttgtgctgctgggtgtgggtggcgcgct

SEQ ID NO: 25566 - DNA, 50 bp, Homo sapiens
cccgctgcccgcagaaggcctcactctggagccggcggggagggcgggga

SEQ ID NO: 25567 - DNA, 60 bp, Homo sapiens
ccccggggacccaggcgggcggggcagggatcggccctgggcctggaagtccccgtccga

SEQ ID NO: 25568 - DNA, 87 bp, Homo sapiens
cagcccagccgcggggttggggggctcggcttggggtccgacccagaggggcgcggggcaggagtccgacctggggcggggggcggg

SEQ ID NO: 25569 - DNA, 60 bp, Homo sapiens
tgggcaccgcgtggcaccgcagggcccgggttggggcggccccctccacgcgccccgcgc

SEQ ID NO: 25570 - DNA, 57 bp, Homo sapiens
aaagcccgtgggggacctgttcactgcagccatgaacatgatcctcccggacttcaa

SEQ ID NO: 25571 - DNA, 57 bp, Homo sapiens; identical to SEQ ID NO: 25570

SEQ ID NO: 25572 - DNA, 72 bp, Homo sapiens
gggctgtgtggctgcgctcggcgcggcgcgtgggctttgctggcgggcggcgcgcgcggctgcggggctcca

SEQ ID NO: 25573 - DNA, 56 bp, Homo sapiens
cggggcgcgcgcccccgggcccagatccgcaggacccagggggcgcgggccgcacc

SEQ ID NO: 25574 - DNA, 63 bp, Homo sapiens
ctccctgcagcggtcagaggatcggttgagttctcagtgaccccaggccctgcagagctggca

SEQ ID NO: 25575 - DNA, 63 bp, Homo sapiens; identical to SEQ ID NO: 25574

SEQ ID NO: 25576 - DNA, 67 bp, Homo sapiens
gaggattcccaggatcctgggtctgttccctgccccagtgctgcagaacggacttgggagccctcct

SEQ ID NO: 25577 - DNA, 69 bp, Homo sapiens
ccgcgcagcgctgggggcgccacgcaacgcaggtcgcggtagggcgcacgctcggggcggccggccagc

SEQ ID NO: 25578 - DNA, 56 bp, Homo sapiens
aggcagcatcaaggctgtgggcaccgaagtgctccagccacaagaggactgcccgg

SEQ ID NO: 25579 - DNA, 63 bp, Homo sapiens
ccctcacacgtgcatctgcatgtggcgtgcatgtggcaagcatgtgcaggtgctgtgtgggca

SEQ ID NO: 25580 - DNA, 84 bp, Homo sapiens
gctagtggcccggccggcctgggctcgggggctccgggctctgggctctgggtgcgcggaccgggccaggctgcttgaaggtgg

SEQ ID NO: 25581 - DNA, 59 bp, Homo sapiens
ctgagaggcagaggttgcagtggcacgatctcaggtcactgcaacctctgcctccggta

SEQ ID NO: 25582 - DNA, 51 bp, Homo sapiens
agagtgatgcagctccctggggacacaggtgcttcctggggagccctgagc

SEQ ID NO: 25583 - DNA, 59 bp, Homo sapiens
cgtgaagctgggggagctcgtcgccgccgccggcggctagcgggcgtccgcgccatgga

SEQ ID NO: 25584 - DNA, 52 bp, Homo sapiens
tgggggctgggggaggggcatcgggcttagatgtcctccctctgctcgcagc

SEQ ID NO: 25585 - DNA, 69 bp, Homo sapiens
ctcctccctgcctagatcagtccttctccaaaaggacctgggagctggcagcctgggcaggggggctga

SEQ ID NO: 25586 - DNA, 77 bp, Homo sapiens
cgccttagactcccaaagtgctgggattacaggtgtgagctactgtgcccagcccttaggtgtgtttctgtagtggt

SEQ ID NO: 25587 - DNA, 60 bp, Homo sapiens
gggaggagctcgaggcccaactaagctgcttccgggagctgctgggcagggcccccacgc

SEQ ID NO: 25588 - DNA, 78 bp, Homo sapiens
gccgcaggtgctctgacgaggttgcactactgtgctctgagaagcagtgcaatgatattgtcaaagcatctgggacca

SEQ ID NO: 25589 - DNA, 85 bp, Homo sapiens
cgcggaggggcgggggaggggcggcggcgcgcggccaggcccgggactgagccacccgctgagtccggcctcctccccccgcagg

SEQ ID NO: 25590 - DNA, 67 bp, Homo sapiens
gcggcggcggcggcggttactccggacctggacgggacgcgcgcccgccgccgccgcccgccgcgcc

SEQ ID NO: 25591 - DNA, 77 bp, Homo sapiens
gggcggccgaggccgccgtcgcagcctcctcgtctcgccggctatggctgcgctcggccggcccttcagcggcctcc

SEQ ID NO: 25592 - DNA, 57 bp, Homo sapiens
ggtgcagccgcctgccgccgccgccgccgctgccgctgctgctcgggctgctgctgg

SEQ ID NO: 25593 - DNA, 66 bp, Homo sapiens
ctgcagcacctgcagccgtcgctctgagggttccagccaccggaaggccccagctgcatctgtctg

SEQ ID NO: 25594 - DNA, 71 bp, Homo sapiens
cctgcccggagggggcgggcggggccgcgcgctcttaaaggggccgccccttccccgagccggcgggagct

SEQ ID NO: 25595 - DNA, 61 bp, Homo sapiens
gctccaggccggtgcctgcggggccaggactcagagcggcctccgcaggccctgccggtgc

SEQ ID NO: 25596 - DNA, 69 bp, Homo sapiens
gcggcgcgcggtcagctacgcctggagcaggagcacctgctcgaggacatcgcgcacgtgcgccagcgc

SEQ ID NO: 25597 - DNA, 69 bp, Homo sapiens
tggggagctcagacagggcaaataggtgggtctttgataaggaatacctttgcctctggctcaccctct

SEQ ID NO: 25598 - DNA, 68 bp, Homo sapiens
cggccgggcagacccaagtgccggcggcggagactgcagtggagccagtaccggctgtagtggccggg

SEQ ID NO: 25599 - DNA, 76 bp, Homo sapiens
gatggcaccactgcactgcgtcctcagcaacagagtgagacccttttgcccaggatgcagtgcagtggtgcctcaa

SEQ ID NO: 25600 - DNA, 62 bp, Homo sapiens
tagggaggcgagattgagccttttgtgaggttacaaattaaagctctgtctgtgtctctagg

SEQ ID NO: 25601 - DNA, 60 bp, Homo sapiens
agggactcgctatgttgcccagactggactcaaactcctgggctcaagcgatcctcccac

SEQ ID NO: 25602 - DNA, 69 bp, Homo sapiens
ggaggtgggctgggggcgaggccagaggcgaggcccagcctgctgaccccgcccctcctccgcctcagc

SEQ ID NO: 25603 - DNA, 70 bp, Homo sapiens
ctggacagcgcaggtcctcgcaaggccgtttctcagggacgccggcctcgccactgacgtagcaccaggg

SEQ ID NO: 25604 - DNA, 60 bp, Homo sapiens
tagcagggtgggggggcaggaactgaggggtgcggatccgggccccccagcctgcgaagc

SEQ ID NO: 25605 - DNA, 90 bp, Homo sapiens
caggcagggctgagagggagcacagcccggggcgtccccagggacacctggggatggcctggggcctcacctgttccagctctttctgca

SEQ ID NO: 25606 - DNA, 67 bp, Homo sapiens
ccccggcctctgtcggctccgtaggctcaggtagacctggcgacgacggggctgcagctgcaggggc

SEQ ID NO: 25607 - DNA, 86 bp, Homo sapiens
tggcagtcaggattgttatgttaactgtcttctgtactctcttgtttatacagaagagaattaacacagcaatcctggctgccatc

SEQ ID NO: 25608 - DNA, 119 bp, Homo sapiens
ggtatgctgttgcgctgtccttcctctggggagcaggctccgggggacagggaaaagcacacaaggaacttgtcctctagggcctgcagtctcatgggagagtgacatgcaccaggacc

SEQ ID NO: 25609 - DNA, 57 bp, Homo sapiens
cgtagtctcctcgctggctgcccgagggaggccgggaagcgatcggggaagctcggg

SEQ ID NO: 25610 - DNA, 50 bp, Homo sapiens
ggggcagatccaggttcaggtgagcgagccccaccgcggtcccgccccgg

SEQ ID NO: 25611 - DNA, 67 bp, Homo sapiens
tagcttgctgctgtgatgagtgacagggtccagaaactcagggacttctactggacagcatgagagg

SEQ ID NO: 25612 - DNA, 58 bp, Homo sapiens
gtccctggaaggcagcttggaggggacgcttccttctccgagggcccacagggagcac

SEQ ID NO: 25613 - DNA, 57 bp, Homo sapiens
ggtgttgggcagctggggtggaggcctccaagaggtcctgacccagacccgtgccca

SEQ ID NO: 25614 - DNA, 78 bp, Homo sapiens
cccggatccagcccgcggagcccgcggccagggcggcgcagaccggcccagcgactctcccgggctgccagccgggac

SEQ ID NO: 25615 - DNA, 62 bp, Homo sapiens
gaggctccccaaacttccggcctccgtgccaccggctcagaggctgggggtgggagctggga

SEQ ID NO: 25616 - DNA, 63 bp, Homo sapiens
gaggcgaggcgaggcgaggcgaggccaagccaattggaggccgtctttcctcgtcttgcccgc

SEQ ID NO: 25617 - DNA, 67 bp, Homo sapiens
ccggcggagacttgggagtccggagcgccgaggaagttggggaacggacccccaggccccgcccacc

SEQ ID NO: 25618 - DNA, 76 bp, Homo sapiens
gtctgcggctcccaggccggtgccgatgacgtcagacttacgtcaggcgtgacgccacggctgggaggagtgagga

SEQ ID NO: 25619 - DNA, 82 bp, Homo sapiens
caggcctcgatggggctgtgcttcctgttgtgagccgtcgccatggcaactggaggcctggtgggctccatgggggtatggg

SEQ ID NO: 25620 - DNA, 70 bp, Homo sapiens
accgggcccctagccagaggggcggggagatgactcctccagtgccaccctccctggctgggcccacacc

SEQ ID NO: 25621 - DNA, 66 bp, Homo sapiens
gggcgcccgccgcagccgctgccgccggagcccgggatggggcgagaggctgcggcggacgccagc

SEQ ID NO: 25622 - DNA, 56 bp, Homo sapiens
cgccgcctccgccgggctcgccgggacctccgggcggcctggcggacgcggtcggg

SEQ ID NO: 25623 - DNA, 62 bp, Homo sapiens
aggcgggaattccatctcattgcgttggaatttaaagcaattgcagatgcttttccctccaa

SEQ ID NO: 25624 - DNA, 62 bp, Homo sapiens; identical to SEQ ID NO: 25623

SEQ ID NO: 25625 - DNA, 71 bp, Homo sapiens
gctgctaacccgacccggattggcgctgaggtggcccgtggggcaggtgagtgcggggcgggagtcagcgg

SEQ ID NO: 25626 - DNA, 70 bp, Homo sapiens
ggggatggaggtggggtgggaagggctagctgggggtgacaagagccttaccaccccttcctcacctcta

SEQ ID NO: 25627 - DNA, 58 bp, Homo sapiens
gggctggaggggaggagacccacagtttcgggcttgagtcacctccctcctggccagg

SEQ ID NO: 25628 - DNA, 70 bp, Homo sapiens
tggtggggtcgggcaggagggccggggattggaaggttggccagctctacctcctgcccttcccaccgca

SEQ ID NO: 25629 - DNA, 71 bp, Homo sapiens
ggcggcgccagcctggctctcggctcgggcgagttctctgcggccattaggggccggtgcggcggcggcgg

SEQ ID NO: 25630 - DNA, 60 bp, Homo sapiens
ccgtcagggggtctgtgtcccagcctctcatcactggctgcacccagagtccctgacttt

SEQ ID NO: 25631 - DNA, 55 bp, Homo sapiens
gccctcgcagctgctgtgccgggactcggggacgcacacgcaggcgcgagggcaa

SEQ ID NO: 25632 - DNA, 55 bp, Homo sapiens
aggttggagtgtgggaactgttgaacgaaacagcagctctcccagcccaacttcc

SEQ ID NO: 25633 - DNA, 67 bp, Homo sapiens
tgagcggggcgggccgggccgggcgactggaggtccaggcggcataggggcccggcgcggcaggggg

SEQ ID NO: 25634 - DNA, 64 bp, Homo sapiens
ggtgcccgggtgaggggcggagctgggggcatggcgtccggagcggctcgctggctagtattgg

SEQ ID NO: 25635 - DNA, 67 bp, Homo sapiens
cgcccaccccccgccccccgccgcgcccgcgctgtccccttaccctggcggccggagggccggcatc

SEQ ID NO: 25636 - DNA, 78 bp, Homo sapiens
gacgaatttttgagcgggtaaaggtcgccctcaaggtgacccgcctactttgcgggatgcctgggagttgcgatctgc

SEQ ID NO: 25637 - DNA, 78 bp, Homo sapiens; identical to SEQ ID NO: 25636

SEQ ID NO: 25638 - DNA, 56 bp, Homo sapiens
tccaggggcagtctgccacccatccttcctgactgcctggccctgtcccctgcaga

SEQ ID NO: 25639 - DNA, 56 bp, Homo sapiens; identical to SEQ ID NO: 25638

SEQ ID NO: 25640 - DNA, 65 bp, Homo sapiens
gtccaggcgccctctggatccgggtctgcctcgaggcggcggaagccccacggggcgctgggcgg

SEQ ID NO: 25641 - DNA, 55 bp, Homo sapiens
cgtccccgcgggaccgggagctcactcctcaaagccacctctcccgcgggacgcg

SEQ ID NO: 25642 - DNA, 87 bp, Homo sapiens
cgaggccgcgagcgcgcccctcccggcggccgggcgcggagaggcggggagggcgggcgtggggaggcgggcggcggcgggcggggg

SEQ ID NO: 25643 - DNA, 53 bp, Homo sapiens
agggggcgtcccgggtcacccggcggcccggatcggcccgtgacgccctcacc

SEQ ID NO: 25644 - DNA, 66 bp, Homo sapiens
gggaggagggaggagatgggccaagttccctctggctggaacgcccttcccccccttcttcacctg

SEQ ID NO: 25645 - DNA, 61 bp, Homo sapiens
aggaggatcacttgagcccaggagtttgagaccagcctgggctacatagtgagactcctgt

SEQ ID NO: 25646 - DNA, 63 bp, Homo sapiens
acccaggcctcccgactcccaggcaccgcctcgtgctcgtgggtccccgcggggcctggggcg

SEQ ID NO: 25647 - DNA, 66 bp, Homo sapiens
tctggtagaagtgggggcagggcgggggcgggcctccagactctgcccatctcactcttgcccatc

SEQ ID NO: 25648 - DNA, 59 bp, Homo sapiens
gcggtgggcggggccccgggagcgctcagcggctcccacctagcgccccgcggccgctg

SEQ ID NO: 25649 - DNA, 56 bp, Homo sapiens
gacatggggaggagacccagggcctggagtgaggctctggggcatgtcccgtgcaa

SEQ ID NO: 25650 - DNA, 66 bp, Homo sapiens
cagcgtctccccacaggagttcccggcactccccaacaaggggtttcttgtggtcagacgtttgga

SEQ ID NO: 25651 - DNA, 85 bp, Homo sapiens
cgcggagggcgtccccgcggtggcggcctccagcgccagtcccacccggacggcgccagccgcgcgccgcagggcgcacagcaga

SEQ ID NO: 25652 - DNA, 64 bp, Homo sapiens
ccggctccccggcgccgctgggctcccgggcgggcggcaggcgtagcgcggccgggcggccggc

SEQ ID NO: 25653 - DNA, 54 bp, Homo sapiens
tgggtgcacctgagcagtatacactgaacagtgtatactgaacagtgcacccga

SEQ ID NO: 25654 - DNA, 66 bp, Homo sapiens
cgccgccgctcctgggcgcgggcccctctcggccgcggcggctccgggcccggcagcggcggccgc

SEQ ID NO: 25655 - DNA, 64 bp, Homo sapiens
ggttcgtgcggaccgtggggtgtcccacgcccaggccgggggatcccagagccccgcttccctc

SEQ ID NO: 25656 - DNA, 72 bp, Homo sapiens
cggccagccccgccccgcgccgcgcggggccctgggaggggcgcagcgtccggcggcgtcgcgggcggcggg

SEQ ID NO: 25657 - DNA, 55 bp, Homo sapiens
gagcgggtgggcggccgggaggccggagcagcacggccgcaggacctggagctcc

SEQ ID NO: 25658 - DNA, 66 bp, Homo sapiens
ggcctccggggagagcagggtgggggctgtagcctggtgcacccccagcctgctgtcccaggtgaa

SEQ ID NO: 25659 - DNA, 56 bp, Homo sapiens
tctgcgtccccggctgtctgcgcatcccgtcgcgcacgtggccgggcgcgcgggga

SEQ ID NO: 25660 - DNA, 56 bp, Homo sapiens
cgggccggggcggcggcggggggcaccggagccgcccgcctccgccgcagcccggc

SEQ ID NO: 25661 - DNA, 69 bp, Homo sapiens
ggccatggcctgcagggcccccacgctgcactcctggctgcaatgcttcgggggctggcagggggccga

SEQ ID NO: 25662 - DNA, 60 bp, Homo sapiens
agtgggcccaagcccctctgggggagaccatggaacaggaggagctctgggcccacccag

SEQ ID NO: 25663 - DNA, 53 bp, Homo sapiens
tgcttctgtctcctgctcagcacatccagttccgggagggcagtggaggcgtg

SEQ ID NO: 25664 - DNA, 61 bp, Homo sapiens
tctgggtgcctccacggagtgggcatggggctggtgctgctcacccctgtggcactctggg

SEQ ID NO: 25665 - DNA, 61 bp, Homo sapiens; identical to SEQ ID NO: 25664

SEQ ID NO: 25666 - DNA, 57 bp, Homo sapiens
caggtggaggtgtgaggtcctggggcatcatggcaggaccttggacatccactttct

SEQ ID NO: 25667 - DNA, 68 bp, Homo sapiens
ctgcttctgctactggagccggggccagcctgggggtggggccctgtgtgtcagtggcagcagacctg

SEQ ID NO: 25668 - DNA, 60 bp, Homo sapiens
ggccggcctgacgaccttgggtccttgcccacaggtggacccaggtgcggggctggctac

SEQ ID NO: 25669 - DNA, 68 bp, Homo sapiens
gggagggtccgtgttgcagatggggcttggggctgggcccggccagacgctaactcggatgctcccag

SEQ ID NO: 25670 - DNA, 59 bp, Homo sapiens
ggccccggcccgggccccggcgcggggatggacggccccggggccagcgccgtggtcgt

SEQ ID NO: 25671 - DNA, 59 bp, Homo sapiens
ggcgggcgcggggggcgcagggcggcccttcggcctcacgccccccaccatcctcaagt

SEQ ID NO: 25672 - DNA, 66 bp, Homo sapiens
ggtttcccagccccgccgaggcccgctggggcgaagcggagccccggggggccctgaggaaaccgg

SEQ ID NO: 25673 - DNA, 80 bp, Homo sapiens
gaggcccgtgcgcccgcggctgcaagcgcccgcctggcggggagaggggccgacggcgtcagcccgggcggcggcatccc

SEQ ID NO: 25674 - DNA, 55 bp, Homo sapiens
tgcttcctatccgtaagataaatgcttcgcccttatcttatggataggaagcagg

SEQ ID NO: 25675 - DNA, 52 bp, Homo sapiens
cgcctgcaggttccgcggggaactgcagaccagactggcggatcagagctgg

SEQ ID NO: 25676 - DNA, 76 bp, Homo sapiens
cccgccggtgtccgcccgtgtcgcgccggggcaccaaggagccgttggagggtccgggcggaggcccgctcgtgtg

SEQ ID NO: 25677 - DNA, 63 bp, Homo sapiens
accacgcctggctcaaattttgtatttttggtacaaaatacaaaagtgagccagacgtggtag

SEQ ID NO: 25678 - DNA, 63 bp, Homo sapiens; identical to SEQ ID NO: 25677

SEQ ID NO: 25679 - DNA, 56 bp, Homo sapiens
atgtgcctaatgactgctagtgtctgtggttgtgcttagcaatcattagacatatt

SEQ ID NO: 25680 - DNA, 56 bp, Homo sapiens; identical to SEQ ID NO: 25679

SEQ ID NO: 25681 - DNA, 88 bp, Homo sapiens
cagcgggctgagtgagctgccgccgccgccgccgccgccgccgccgccgccgctgccgggggaggggcggccgccgcccgcctgcgct

SEQ ID NO: 25682 - DNA, 71 bp, Homo sapiens
tgtgatggtggggggaaccaggagttgaagggcagagatttgtcaccaccacgtcctcttccctccacagc

SEQ ID NO: 25683 - DNA, 118 bp, Homo sapiens
gcggccacagctcggcgccaaccaccgcgggcctcccagccagccccgcggcggggcagccgcaggtacagccgggccccccatccctgcacccctgggcgctgcgtgggggcggtgg

SEQ ID NO: 25684 - DNA, 118 bp, Homo sapiens; identical to SEQ ID NO: 25683

SEQ ID NO: 25685 - DNA, 62 bp, Homo sapiens
cccgcgatggtgagagagccgggcccccggccagggacccccggctgttcggcctcagggca

SEQ ID NO: 25686 - DNA, 57 bp, Homo sapiens
ctggagaagtatgggcggcctgagtacgtttcctctctgccaataccttctcccgcc

SEQ ID NO: 25687 - DNA, 65 bp, Homo sapiens
actgaggggatgaaggatcaggccctatcagcagctgactggcctcccttcctgcccctcagaga

SEQ ID NO: 25688 - DNA, 90 bp, Homo sapiens
ggggccccgggcgggggtcgctggggctgcagccgggaatgccctccgcggggcggcctgggcggcagctccgcccccggggccgcggtt

SEQ ID NO: 25689 - DNA, 55 bp, Homo sapiens
agctccgcgccctgccgccccggcgcgtccgcggggcagcgggcggcggagcgcg

SEQ ID NO: 25690 - DNA, 81 bp, Homo sapiens
tggtgccccggaggttctggagaacttggaggtgagtggcatctgcatgcctcaggccaggccggagtcaggggcatcagg

SEQ ID NO: 25691 - DNA, 63 bp, Homo sapiens
tactgtaaaatgctaaacatgacgaaaggcagtagcatgtttagcattttacagcatcacagt

SEQ ID NO: 25692 - DNA, 63 bp, Homo sapiens; identical to SEQ ID NO: 25691

SEQ ID NO: 25693 - DNA, 66 bp, Homo sapiens
gatgctgtaaaatgctaaacatgctactgcctttcgtcatgtttagcattttacagtatccacagt

SEQ ID NO: 25694 - DNA, 66 bp, Homo sapiens; identical to SEQ ID NO: 25693

SEQ ID NO: 25695 - DNA, 60 bp, Homo sapiens
gtcattgctgcctgttggtgttgtggttacagacaagctcaccagtgccagcaaggagtc

SEQ ID NO: 25696 - DNA, 60 bp, Homo sapiens; identical to SEQ ID NO: 25695

SEQ ID NO: 25697 - DNA, 91 bp, Homo sapiens
tgcgtctgtccctcgccggagcccgcggccgccgcgctctcgctcgctgcgcccagcgcccggcgcgctccggctccagccccgacgcgcc

SEQ ID NO: 25698 - DNA, 66 bp, Homo sapiens
gcagggcgggcagggcgagctgggcggggtggctgcttgcagtctgcctgctttccctgccccagg

SEQ ID NO: 25699 - DNA, 76 bp, Homo sapiens
cggcggcagcggcagcggagccgctagtcccctccctcctgggggagcagctgccgccgctgccgccgccgccacc

SEQ ID NO: 25700 - DNA, 51 bp, Homo sapiens
ttggcggcgaggtctcggcggctaagcgagcgtcggcgactgtctctccgc

SEQ ID NO: 25701 - DNA, 51 bp, Homo sapiens; identical to SEQ ID NO: 25700

SEQ ID NO: 25702 - DNA, 51 bp, Homo sapiens
gcggcggcggcggggtgtgcgccaggaggccatttcctcgctgcgcccctg

SEQ ID NO: 25703 - DNA, 77 bp, Homo sapiens
gcggacgccgcgcctcgagtttgagggcagccggcggcgcggcctcctcagcgggctcggctggacgtccgctccgg

SEQ ID NO: 25704 - DNA, 58 bp, Homo sapiens
ggggcctgatgtgatgaaggcaggtgttggtagattgtttcgttgtcaaataccctgt

SEQ ID NO: 25705 - DNA, 84 bp, Homo sapiens; identical to SEQ ID NO: 19418

SEQ ID NO: 25706 - DNA, 68 bp, Homo sapiens
cggccgcagcaaccgcgccgttgacttctcggactccagaagtccccggtagccgggaggcggccgtc

SEQ ID NO: 25707 - DNA, 63 bp, Homo sapiens
gctagcgctgctgtgcgtggcctgcgcgctgcgcgccgggcgcgcccaatacgaacgctacag

SEQ ID NO: 25708 - DNA, 80 bp, Homo sapiens
tgcaaaagtaatcacggtttttgctattgaaagtaatagcaaaaactttcaatagcaaaaactgtgattacttttgcatc

SEQ ID NO: 25709 - DNA, 61 bp, Homo sapiens
ctgcatctcaggtctgcacctctggtcttgctcagcaccacagggcaactctgggatcaca

SEQ ID NO: 25710 - DNA, 61 bp, Homo sapiens
attcccagggaagtgctctgataggccaagtttgtatcaggtgcccatccctggaaggtgc

SEQ ID NO: 25711 - DNA, 62 bp, Homo sapiens
ccggagagtaaggcactgggtttgaaggacaaaatcaaccacactggccttacttcctgacc

SEQ ID NO: 25712 - DNA, 69 bp, Homo sapiens
actccatcagagagtcaaaactttaaatcagtagtcaatattgaaagctttgtctctctgatggagttt

SEQ ID NO: 25713 - DNA, 66 bp, Homo sapiens
tcattgtgctttcaaggaaaaacagcaaagtatttttttcgtttttttttaattggtatgttgata

SEQ ID NO: 25714 - DNA, 62 bp, Homo sapiens
cccccgcggcctgggttggggaaggtggccctggtatcctcccctgtcccaagcccgacgcc

SEQ ID NO: 25715 - DNA, 61 bp, Homo sapiens
ggggcgcggagggcggcggccgggcccgggttccggtcgcgctgcctctctggggccctgg

SEQ ID NO: 25716 - DNA, 53 bp, Homo sapiens
ctggggccgcagctgcttggcgctggactcgccgcggccctgcgcctccgcct

SEQ ID NO: 25717 - DNA, 60 bp, Homo sapiens
cgctgcggcggctggtgagtcggggagggcacctcggaccccccagctgtccgcagcaga

SEQ ID NO: 25718 - DNA, 86 bp, Homo sapiens
cagcaggccctgaatcaggagcgggtgggcggtgtggggcctgctgacacccacgagcccctgcgccctgaggcggagcctgggga

SEQ ID NO: 25719 - DNA, 58 bp, Homo sapiens
tgaggacagcagctccgagtctgtgtgtgtttgtggaccggtgctcctgtctaacgga

SEQ ID NO: 25720 - DNA, 62 bp, Homo sapiens
catgcctgggtcctgagggcagagtcaggagacaggtctgccttgagcccccagggcagcag

SEQ ID NO: 25721 - DNA, 56 bp, Homo sapiens
ctgccactatattatgtgcaaggagagatgctaggtgggcagtagatagtcagtct

SEQ ID NO: 25722 - DNA, 71 bp, Homo sapiens
gcctgaagagcctatgtgcacagtggctaagtgcaaagacttgaaagccacagtacctgggttcttctcct

SEQ ID NO: 25723 - DNA, 87 bp, Homo sapiens
cggcggcggcggcggcgccgtgcaacatcagcgtgcagcggcagatgctgagctcgctgctcgtgcgctggggccgcccgcggggct

SEQ ID NO: 25724 - DNA, 60 bp, Homo sapiens
ctctgcctcctcaccttgcacccagagcaagaggactgggtgctgggctgcagaggccgg

SEQ ID NO: 25725 - DNA, 60 bp, Homo sapiens
tgcaaattagagtctctaggggtgggatccagacatctccaagtgattccaatgagcagc

SEQ ID NO: 25726 - DNA, 78 bp, Homo sapiens
tggaggttggggcccaggaagaggagtgggggctggggcccacatcgagcactgttctcctctgcccaatcctccagg

SEQ ID NO: 25727 - DNA, 76 bp, Homo sapiens
gcctcgtgtgatgctgggcccatggttgcaagccatcaggtgagtgtgactttgggctgggccataccgggggggt

SEQ ID NO: 25728 - DNA, 81 bp, Homo sapiens
cctgaggatgaaggtcagaaaaattagcctgattatgggcctcagttgcggggctgatgtctggctggctttcctaaaagg

SEQ ID NO: 25729 - DNA, 54 bp, Homo sapiens
ttccggagcgtagcggcctctagctcgagcagcaggagcagcccgcaccggaca

SEQ ID NO: 25730 - DNA, 54 bp, Homo sapiens
gagatggtgagggcagggagtgtgctgagtcatgccttgccctctccctctagg

SEQ ID NO: 25731 - DNA, 65 bp, Homo sapiens
ggacgaaatccaagcgcagctggaatgctctggagacaacagctgcttttgggattccgttgccc

SEQ ID NO: 25732 - DNA, 65 bp, Homo sapiens; identical to SEQ ID NO: 25731

SEQ ID NO: 25733 - DNA, 64 bp, Homo sapiens
ccgctctcgcgccacctagctcaccggcgaacagtggagcggaaaggcacacgcgagaggggtg

SEQ ID NO: 25734 - DNA, 88 bp, Homo sapiens
cccagtgggcagcgccgggagctggaccaagcggccggtgagaggccgctgtagcggtgctcagccacctgtgctgcctgccaggggg

SEQ ID NO: 25735 - DNA, 109 bp, Homo sapiens
cctaggaaaggctgctggtaactgggatgggggttggggggaggtaagaagtctctgactcctcctctacctcatcccagttccatcacctgaagtggacctcttggga

SEQ ID NO: 25736 - DNA, 64 bp, Homo sapiens
aactgggatgaggtagaggaggagtcagagacttcttacctccccccaacccccatcccagtta

SEQ ID NO: 25737 - DNA, 54 bp, Homo sapiens
ttgggggctgggcagcagctggagaaggagctgctgtgcccttgcccaccaacc

SEQ ID NO: 25738 - DNA, 51 bp, Homo sapiens
cggggaagccccgggctcagccctaggggcggatcctggggcttcctccct

SEQ ID NO: 25739 - DNA, 88 bp, Homo sapiens
ttcctaggtggcgtcctggtggcactcaagcaaaccatgggggactgtgtggtcctgcgagtgccccaggtgcgcgtcagtgtgatgc

SEQ ID NO: 25740 - DNA, 62 bp, Homo sapiens
ctggggcgggggcggaggccgggcccaagctgcagggtgctcggcctttccctgcgcccggc

SEQ ID NO: 25741 - DNA, 65 bp, Homo sapiens
cgccgtgggtcccggccctacccaccctagctcaggccggcagagccagcgctcgcggatgcggc

SEQ ID NO: 25742 - DNA, 67 bp, Homo sapiens
tcgccttccccaacctcaggtctgacccagagtaaagaaagagacctcaggttaatgggaagccact

SEQ ID NO: 25743 - DNA, 57 bp, Homo sapiens
aggttgtctgtttactcaggtttgcttctggtttgctagagtaaacagacaacctct

SEQ ID NO: 25744 - DNA, 53 bp, Homo sapiens
gcctccgcccgccctgtgtgtcgatttgcaggcaggcggggcagcggaggtga

SEQ ID NO: 25745 - DNA, 61 bp, Homo sapiens
tggctcaaggttcaagaaggccaatgttgtgagcacaggccttctcgagccttgagtgtgc

SEQ ID NO: 25746 - DNA, 61 bp, Homo sapiens; identical to SEQ ID NO: 25745

SEQ ID NO: 25747 - DNA, 89 bp, Homo sapiens
gcggtgccctcagttccccagcatggccccctcggcctgggccatttgctggctgctagggggcctcctgctccatgggggtagctctg

SEQ ID NO: 25748 - DNA, 54 bp, Homo sapiens
agggatagggctggggagcgccggcctgtggccctgaccagccccttctcgtgc

SEQ ID NO: 25749 - DNA, 71 bp, Homo sapiens
gacatgcggagactggtgcacggtgggtgagccggggcgggacgtgcgccggggtgtcttccgcgtggact

SEQ ID NO: 25750 - DNA, 58 bp, Homo sapiens
tgccttacaattatgaggtactctagttctatgaggttcctcataattgtaaggcaca

SEQ ID NO: 25751 - DNA, 75 bp, Homo sapiens
agggcgggcactgggttcccggggacgcgtctcctcttccgggccgttccgctcggggccacagcgccgtcgggg

SEQ ID NO: 25752 - DNA, 75 bp, Homo sapiens
attaggacatggggggcagggttggaaggagaagaaatgtcccctgctgactcttacctgtcccctgtccttagg

SEQ ID NO: 25753 - DNA, 60 bp, Homo sapiens
gtgcaaaagtaattgtggtttttgcaattaatgtcaagaaacacaaatattttgcaccaa

SEQ ID NO: 25754 - DNA, 57 bp, Homo sapiens
agctcatggtatgtggtcagtgctgttatgaacacctgcccatcacccatgtgctgt

SEQ ID NO: 25755 - DNA, 57 bp, Homo sapiens; identical to SEQ ID NO: 25754

SEQ ID NO: 25756 - DNA, 53 bp, Homo sapiens
cccaggggagccgccgccgcagccgccgccgccgcggtgagttttccagcctg

SEQ ID NO: 25757 - DNA, 53 bp, Homo sapiens
cgcgccgcagagcgcgcttgcctccgcgcaggcgcagacgctgctgtcgcagc

SEQ ID NO: 25758 - DNA, 88 bp, Homo sapiens
acacctatatatatctaagctttcaaacatgcatcttagatgccagtgtatctagcatgtttgaaagctcagatatgtataggtatgc

SEQ ID NO: 25759 - DNA, 59 bp, Homo sapiens
aggctgggggaagcgggaaggtgatggtctcctgacagctccccacttcccaccccagg

SEQ ID NO: 25760 - DNA, 58 bp, Homo sapiens
ggaggcaggggttctgtcctgtgcactgtaagttgtttagcaccatttctggcttcaa

SEQ ID NO: 25761 - DNA, 120 bp, Homo sapiens
attttgatatataagccagtttaatgttttctatacagaccctggcttttcttaaattttatatattggaaagcccatgtttgtattggaaactgctggtttctttcatactgaaaatct

SEQ ID NO: 25762 - DNA, 56 bp, Homo sapiens
cccggatgccttgtccttagctcctggattggagcctagcacaagtcagtccgcac

SEQ ID NO: 25763 - DNA, 56 bp, Homo sapiens; identical to SEQ ID NO: 25762

SEQ ID NO: 25764 - DNA, 87 bp, Homo sapiens
cctccctccctccagtccgcccggtctcccctccctccagcgtccgcgtcggagccggagccggagccggagtggcggaggcacggg

SEQ ID NO: 25765 - DNA, 52 bp, Homo sapiens
ggaccggagcgctaggcgccgcggagctgcgagcctgtgcgcctcggtctga

SEQ ID NO: 25766 - DNA, 66 bp, Homo sapiens
tgtgtgtgtgtgtgtgtgtgtgatattttggcttacaatatattaacctatagcataataatgtta

SEQ ID NO: 25767 - DNA, 60 bp, Homo sapiens
tgtgtgtgcatggatatatatatatatatatatatggatatatatccatgcacacacaca

SEQ ID NO: 25768 - DNA, 60 bp, Homo sapiens
aaggagatctgagagctggaagtggggagcgtgttaccttccagttgccagatccttcca

SEQ ID NO: 25769 - DNA, 89 bp, Homo sapiens
gcctggtcccagcgcagcgcagccggacgcgtctgccggccccctggcccggctggcacggagcagagccgcgggctggggcacggctc

SEQ ID NO: 25770 - DNA, 68 bp, Homo sapiens
ctgccagctgggtgccccctgcctgcctggttctgcccaagggactggggcgggactcccaaggagag

SEQ ID NO: 25771 - DNA, 54 bp, Homo sapiens
gccgacagctccctgagccagcccgggaggcagccgcgcgcagcgagccggtgg

SEQ ID NO: 25772 - DNA, 91 bp, Homo sapiens
ggacgggcgggacgagggggcggggcggcaggcacagcgcgcgaagacggggtgcgcgatcctcgcaccccaggcagcccgcgacggaccg

SEQ ID NO: 25773 - DNA, 72 bp, Homo sapiens
cccggctgtcagcggccccctcccgcagtcacttacccgccggctgcgcggtctcggccgcggtggcggcgg

SEQ ID NO: 25774 - DNA, 57 bp, Homo sapiens
tggctcagttcaagtccaacagcctcagaaccactgaggctgttggtgtaattctca

SEQ ID NO: 25775 - DNA, 70 bp, Homo sapiens
cgggcggggcggggcggggcggggcgcgggggcgcgcgcgctcatccagctcagggcccgctggctcgcc

SEQ ID NO: 25776 - DNA, 70 bp, Homo sapiens
cttggatcctcaacacacccattctacgcttcaattctacacttaagtgggtgtgtcggggatccaagga

SEQ ID NO: 25777 - DNA, 55 bp, Homo sapiens
ggctccgggcagtgccgagcctgccccttgggctcggggtctggccggagtcccg

SEQ ID NO: 25778 - DNA, 76 bp, Homo sapiens
ggcccatgggtcttatcctgcaaggtgctgcagagacgaggcctgtagcaccttgcaggataaggtctactgggcc

SEQ ID NO: 25779 - DNA, 68 bp, Homo sapiens
gtgtatatacgtatatatgtatatatatgtgtatatacgtatatatacgtatatgtctatatacgtat

SEQ ID NO: 25780 - DNA, 51 bp, Homo sapiens
gcgcggcccctgcagtccggcggagagcggagctgaggatggctgtgcccg

SEQ ID NO: 25781 - DNA, 61 bp, Homo sapiens
gcagattcccagagtgggacagggaggctccacattgcctgccctccttgggaatctacaa

SEQ ID NO: 25782 - DNA, 61 bp, Homo sapiens; identical to SEQ ID NO: 25781

SEQ ID NO: 25783 - DNA, 80 bp, Homo sapiens
gtccgtaatggggcagtgagggagataactgcttgctggccagtgagccctcctcccctcacaagccctggacagggctt

SEQ ID NO: 25784 - DNA, 64 bp, Homo sapiens
gcaggggcaggcggtggaggttgtgactctgcttgctttctccctctccctccttgctcctacc

SEQ ID NO: 25785 - DNA, 78 bp, Homo sapiens; identical to SEQ ID NO: 19431

SEQ ID NO: 25786 - DNA, 67 bp, Homo sapiens
ccagggcccgcgcccagggcacggggaggaccgccgccagccctgccttggggcccgggctctccgt

SEQ ID NO: 25787 - DNA, 51 bp, Homo sapiens
ggggccggggaagtgagcggagtgaggctgcgagcgcgctccccgcctcaa

SEQ ID NO: 25788 - DNA, 60 bp, Homo sapiens
accgatgttcagctcagtaggctgtgtgaagaagctgtccattgagctgaacatcagtgt

SEQ ID NO: 25789 - DNA, 88 bp, Homo sapiens
atcccagatcagatgccaaagccagtggggactggacaacatgatgagcccaaaccaatccacgctgagcttggcatctgatttggga

SEQ ID NO: 25790 - DNA, 86 bp, Homo sapiens
gaggttgcggtggcactggccaggggaggagatgggcagccccttaccctggccaggccctcctctggcaccgcgtgcaggcacag

SEQ ID NO: 25791 - DNA, 78 bp, Homo sapiens
cgcccctgtgtgtgtgcgcacccttttgtgtgcatacaccctgctgtgtgtgccggtgcgcacatccccagggccgaa

SEQ ID NO: 25792 - DNA, 68 bp, Homo sapiens
caggcagtgccccgtagagactctgtgcaggggttccaaccccacatttccactgggcactgcctaaa

SEQ ID NO: 25793 - DNA, 54 bp, Homo sapiens
ggcgccgcctgggccggggcgggcgtggaggccgcgggcgcgggggggaggtgc

SEQ ID NO: 25794 - DNA, 74 bp, Homo sapiens
agcgagggtcagggaggggggtcgaggtgggcgtgggagtccagcctgctgacgctgccttgccctcccagtcg

SEQ ID NO: 25795 - DNA, 66 bp, Homo sapiens
tcgtggtgggactttggggggtgtcaggcgctggcggcacgcctcactcccccttcctcgcgcagg

SEQ ID NO: 25796 - DNA, 60 bp, Homo sapiens
ttcttgccatcctcagcgctgggggtgactccaagcccccgggtgggggtggggagtggc

SEQ ID NO: 25797 - DNA, 52 bp, Homo sapiens
aggtcctgaagctgatgcctgccccacaggagcgcacagactcagagccaga

SEQ ID NO: 25798 - DNA, 84 bp, Homo sapiens
aggcaggtggagctcacgggcacggcttatgggcttccccagaggctctagacacgggcgtgcccatgagctccacctgcctgc

SEQ ID NO: 25799 - DNA, 84 bp, Homo sapiens
aggcaggtggagctcatgggcacgcccgtgtctagagcctctggggaagcccataagccgtgcccgtgagctccacctgcctgc

SEQ ID NO: 25800 - DNA, 84 bp, Homo sapiens; identical to SEQ ID NO: 25799

SEQ ID NO: 25801 - DNA, 70 bp, Homo sapiens
cgggcgcggccggctcccggcgcgcggacaagaagcccgccaggggccagaagccggagcagcgctcgca

SEQ ID NO: 25802 - DNA, 77 bp, Homo sapiens
cactgcaagcccaactggatgtaggactcggtgagcttcttggcgtcgccgccggcgccgtggggcaggcagatgcg

SEQ ID NO: 25803 - DNA, 52 bp, Homo sapiens
gcagccgcctgctcgtgggcgccacgtacaccggttacggcagctccttctt

SEQ ID NO: 25804 - DNA, 73 bp, Homo sapiens
gaggcgggagcagaccagcacggcctcgcggagccggcccggcggaccgtgacgggtcccctcacctcctctt

SEQ ID NO: 25805 - DNA, 60 bp, Homo sapiens
ccgcgccgtctccctggccacggttccaaacagccgtggcccgcggtgtctggcgctcgg

SEQ ID NO: 25806 - DNA, 77 bp, Homo sapiens
tgatcttgtttaggccatcatcccattatgctaagtccatgggcaaacataacaggatgatggcctaaacaagacca

SEQ ID NO: 25807 - DNA, 52 bp, Homo sapiens
ctatgtttagaactgctttgagtatttcttgtaagtcaagtctgaaggtgcc

SEQ ID NO: 25808 - DNA, 67 bp, Homo sapiens
agttgggctggcagggtgtggggagaggcctcactgccgattcctctaccgttgccagcccggctgc

SEQ ID NO: 25809 - DNA, 57 bp, Homo sapiens
aacaccatttcctctctgctcctctcccatagggagcacatgagctgatggtgggct

SEQ ID NO: 25810 - DNA, 52 bp, Homo sapiens
gtgccttagttattagagggactcaactcaagagaccatgatgagagggaca

SEQ ID NO: 25811 - DNA, 61 bp, Homo sapiens
gaggtgagcgggtttgcgccgtgatctgcagccccagatcgccagccatgctcagcctcca

SEQ ID NO: 25812 - DNA, 67 bp, Homo sapiens
cttctttagcacggacatggttctggggtcttgatatagacagaacaatgtctgtgctaaagaagcc

SEQ ID NO: 25813 - DNA, 67 bp, Homo sapiens
cttctttagcacagacattgttctgtctatatcaagaccccagaaccatgtccgtgctaaagaagcc

SEQ ID NO: 25814 - DNA, 57 bp, Homo sapiens
tgcccggattatcacttactagttttgtgactagtgagtgataatctgggcatctgg

SEQ ID NO: 25815 - DNA, 57 bp, Homo sapiens; identical to SEQ ID NO: 25814

SEQ ID NO: 25816 - DNA, 58 bp, Homo sapiens
tgtttagcatcctgtagcctgcatcctactctgtaggttgtaggatgctaaacagagg

SEQ ID NO: 25817 - DNA, 58 bp, Homo sapiens; identical to SEQ ID NO: 25816

SEQ ID NO: 25818 - DNA, 61 bp, Homo sapiens
gccggcgggagttccgggtgggcgtgggcttggcagaccccgcacttggagccgctggttg

SEQ ID NO: 25819 - DNA, 54 bp, Homo sapiens
cgggcgggacggcggccgccgcgcgctcaggctcagcttcgctgcccgcccagg

SEQ ID NO: 25820 - DNA, 62 bp, Homo sapiens
ggtaacataaaagcagtttaatttcattagaatttactaaatgtctactgtgatacagtcaa

SEQ ID NO: 25821 - DNA, 77 bp, Homo sapiens
cggcttgtgctcagacctcgcgcttgcggcgcccaggcccagcggccgtagctagcgtctggcctgagaacctcggc

SEQ ID NO: 25822 - DNA, 57 bp, Homo sapiens
agaagctcaaatcaagcccttgctgttatgatcaagagtttgctttggctttgtttt

SEQ ID NO: 25823 - DNA, 59 bp, Homo sapiens
atccgtcgcgccgagaacgctggttagtcttgtttcgggttccggctgcgttgggcttg

SEQ ID NO: 25824 - DNA, 89 bp, Homo sapiens
cctgagcaccatttactgagtcctttgttctctactagtttgtagtagttcgtagcagagaacaaaggactcagtaaatggtgctcagg

SEQ ID NO: 25825 - DNA, 66 bp, Homo sapiens
tagcatataattacaactctgaccaaagttttatgaattaaacaaagttgtaattatatgccatta

SEQ ID NO: 25826 - DNA, 65 bp, Homo sapiens
tggcatataattacaactttgtttaattcataaaactttggtcagagttgtaattatatgctatt

SEQ ID NO: 25827 - DNA, 65 bp, Homo sapiens; identical to SEQ ID NO: 25826

SEQ ID NO: 25828 - DNA, 58 bp, Homo sapiens
tcagccccggggaggtcgtgctgccagtgtcggtgcttggccgccctcgaggcggggt

SEQ ID NO: 25829 - DNA, 72 bp, Homo sapiens
gggcgacacactgctctggggaaggtaaattgatgcaatttgatacattccccagagcagtatatcgcccct

SEQ ID NO: 25830 - DNA, 90 bp, Homo sapiens
atgtgtatatgtatatacatgtgcatatatatgtgtatatgtatatacatgtgcatatatatgtgtatatgtatatacttgtgcatatat

SEQ ID NO: 25831 - DNA, 53 bp, Homo sapiens
tttcagtaactcaaataaaaaatatgtttgttttgtttgtttgttgtctttat

SEQ ID NO: 25832 - DNA, 86 bp, Homo sapiens
ctaccccaaaatatggtaccctggcatactgagtattttaatactggcatactcagtatgccatgttgccatattttggggtagca

SEQ ID NO: 25833 - DNA, 50 bp, Homo sapiens
gggaaggggaggggagggggagactttctcctcttctcttcccccccacc

SEQ ID NO: 25834 - DNA, 58 bp, Homo sapiens
ggcgtcgccactgcgcatgtgcttggcggagcaggcccggcagcggtggcagcggtag

SEQ ID NO: 25835 - DNA, 56 bp, Homo sapiens
cgggggagaggggccgggaggcgggggccgtgccgcccgctctcctctccctcggc

SEQ ID NO: 25836 - DNA, 51 bp, Homo sapiens
gggggcgggagtcgtgcatgcagcgttgtgtgacgaggcgccgcccgccgc

SEQ ID NO: 25837 - DNA, 64 bp, Homo sapiens
gtgtccagcctgggcaggagcaactccgcacacgtgggtgccaggcccagctagctggacactt

SEQ ID NO: 25838 - DNA, 85 bp, Homo sapiens
gccgaggtggtgtccggcttcgaggccgaggccgccggacggcgcgtctccttccagctgcagagccggcgccgctcgcaggccg

SEQ ID NO: 25839 - DNA, 66 bp, Homo sapiens
cggcggagatggaggagggaggccgggacaaggcgccggtgcagccccagcagtctccagcggcgg

SEQ ID NO: 25840 - DNA, 66 bp, Homo sapiens; identical to SEQ ID NO: 25839

SEQ ID NO: 25841 - DNA, 82 bp, Homo sapiens
cgcgcgggcgcggactgaggctgcgcgccgcaggttccggctgctggcggcgttgcggccgcaggtttgactcccgtgcggt

SEQ ID NO: 25842 - DNA, 55 bp, Homo sapiens
gaggagccggagctggctcggggctgctcccacccgccagcgccggctgcccagc

SEQ ID NO: 25843 - DNA, 50 bp, Homo sapiens
ctggggtgctggggtgggttgtcaggcatgactcacctctgctcccctct

SEQ ID NO: 25844 - DNA, 88 bp, Homo sapiens
gttccagacacatctcatctgatatacaatattttcttaaattgtataaagagaaattattgtacatcggatgagctgtgtctgggat

SEQ ID NO: 25845 - DNA, 60 bp, Homo sapiens
catccgatgtacaataatttctctttatacaatttaagaaaatattgtatatcagatgag

SEQ ID NO: 25846 - DNA, 69 bp, Homo sapiens
aaagagcactgagttataatgccaaagtgaccagcatcgtgactttggaattataactcggtgctctgt

SEQ ID NO: 25847 - DNA, 82 bp, Homo sapiens
gctggccgaggcgccgccgcggcaggcgtccaagcccaagggctacgctgtgagcctgcactactcggcgctcagctcgctg

SEQ ID NO: 25848 - DNA, 87 bp, Homo sapiens
taaaaaatagatggtacctggagagctcattttattccattttcccacatcttgactctgctgttaataccatccattattttgtgg

SEQ ID NO: 25849 - DNA, 57 bp, Homo sapiens
tggcgagctcatgggccagatgggctgaaaggacagctggctcttttgctctccagc

SEQ ID NO: 25850 - DNA, 69 bp, Homo sapiens
gggagcggctgctcctgggagggttgtgggtgtgccccgccccgcccttccgtcgaaggcccccgttgg

SEQ ID NO: 25851 - DNA, 55 bp, Homo sapiens
cccagacagctgcagcaatgtgtcctctgccacccactgctgctggtgtctgtgt

SEQ ID NO: 25852 - DNA, 52 bp, Homo sapiens
gcggctcgggacggaggacgcgctagtgtgagtgcgggcttctagaactaca

SEQ ID NO: 25853 - DNA, 80 bp, Homo sapiens
cggggcctgaggctcctggacttgaggtattaggctggtgcagaagtaattgcggcggccgggtgcgggggctcaggcct

SEQ ID NO: 25854 - DNA, 72 bp, Homo sapiens
aggccagcgccggcgtcgcggcagccgcttcagaggaagctcggcggctgtggccgcggcgaacaggccgga

SEQ ID NO: 25855 - DNA, 69 bp, Homo sapiens
aggccgggcgggagcgcggggacgtacacggcggccccgcccgcgcgctcctcctccctcccggcccgc

SEQ ID NO: 25856 - DNA, 59 bp, Homo sapiens
cgcgagtgggaggtggcaggcctgcgactccggccttgtccgcgcccgctctcggcgcg

SEQ ID NO: 25857 - DNA, 77 bp, Homo sapiens
ctttctccgcccacccagcggtccggccgcgcatgcgctgagctggcgggcccgagtgttgtcggctgggaaatggc

SEQ ID NO: 25858 - DNA, 57 bp, Homo sapiens
cagaagtaattgcggttttcgcattactttaacggcaaaaccacaattactcttcca

SEQ ID NO: 25859 - DNA, 57 bp, Homo sapiens; identical to SEQ ID NO: 25858

SEQ ID NO: 25860 - DNA, 62 bp, Homo sapiens
gcggggccgcgggcggggtggggggttgggggggaacgagcctcctgggaggggccccgcgg

SEQ ID NO: 25861 - DNA, 61 bp, Homo sapiens
gatgcggcgcccggggcggcgatgaccgcggagcgcacgccgcgggcccggccctgacccc

SEQ ID NO: 25862 - DNA, 61 bp, Homo sapiens
cggaggccaggctggccgggctgggcgccagaactcacctcgggcggcggcggccggcggg

SEQ ID NO: 25863 - DNA, 62 bp, Homo sapiens
gcgcgggtgccgggtatgaccgtggaggaggccgctgccctcagaccgggcccaaagcgcag

SEQ ID NO: 25864 - DNA, 50 bp, Homo sapiens
ccccctgccctgcctcctgatgtcatggctggcagcagggcactggggcc

SEQ ID NO: 25865 - DNA, 52 bp, Homo sapiens
ggacctgggtctgggcggggtcttcactgcacctgccctgggcctgggctcc

SEQ ID NO: 25866 - DNA, 63 bp, Homo sapiens
aggcctgatgggtggatgccccggggcggatgctcggcccctgcgccctccctgcgggccccg

SEQ ID NO: 25867 - DNA, 62 bp, Homo sapiens
tgaggagcctctgtgacctgagctgcccttgtggcctgagctgggtctgagggctgctctcc

SEQ ID NO: 25868 - DNA, 69 bp, Homo sapiens
gtgggagggcggaggttgtaaggcggtcccgaacctcccgtgcccagccgaccgcgtccctccccgcag

SEQ ID NO: 25869 - DNA, 65 bp, Homo sapiens
gagggccgggcagtcgggcttcgcggctgcccgcggtcccgaggcctcgccctagccccagtcgg

SEQ ID NO: 25870 - DNA, 71 bp, Homo sapiens
tctaagtggtgtcctgtggcagggctctagggctctctacctggtgcctagcccaggatgaaactctgaca

SEQ ID NO: 25871 - DNA, 77 bp, Homo sapiens
gagaagctggggtgggggcccacccacaggggcagatgtgcaggtggcccctgggtccctccccagtagctgcccag

SEQ ID NO: 25872 - DNA, 77 bp, Homo sapiens
tcccggcgtgcaccggggcggctggctcctggggctcgctgcatcctggttcccgtcgtaccgtggacgccggggct

SEQ ID NO: 25873 - DNA, 71 bp, Homo sapiens
cccgcttgccggtcagggcctgccgagctgcctgccccttccagctgggcagagtcccctgcaaggaggca

SEQ ID NO: 25874 - DNA, 54 bp, Homo sapiens
gcggcgccgacacgtgcagcaaggccgcctgcctgctgcgctcggccgccctct

SEQ ID NO: 25875 - DNA, 76 bp, Homo sapiens
ctcgtcgccgcaggtcccgcccgcgccgcgcggccttctgggcgttgtggtcgggcgtagggctaggccggcagga

SEQ ID NO: 25876 - DNA, 67 bp, Homo sapiens
gcggcagccggcggggcccgggcgcggaagttgccggcggccgcgcggcctcccgggcgggcctaca

SEQ ID NO: 25877 - DNA, 60 bp, Homo sapiens
tcctgcccacattggactaaggcctgagtccatcaggagtggccagtgttgggcagcccc

SEQ ID NO: 25878 - DNA, 59 bp, Homo sapiens
cggggcgaccccgccggggcctgcggaggcccagggtcccgcgcggagtacaccccggc

SEQ ID NO: 25879 - DNA, 61 bp, Homo sapiens
cgcactgtctgtccctctgtgtgagcgtgtgcacgcgccacatggggaaaagcagtgctac

SEQ ID NO: 25880 - DNA, 59 bp, Homo sapiens
acctgagaagtggtgcgagtgcatcctttatgtcatcactcacaccgcctctcaggtac

SEQ ID NO: 25881 - DNA, 68 bp, Homo sapiens
ccgggctgcgcgggctggggccgccgccgccgccgctgtcgcaggcccctccctcgcgccgcccgctc

SEQ ID NO: 25882 - DNA, 65 bp, Homo sapiens
tgccgcagggatggggcagctgtgctggctgccgctgctggcaccgctcctgttgctgcgaccgc

SEQ ID NO: 25883 - DNA, 80 bp, Homo sapiens
cacgctcgcactccagggaggccaggtcctcgccgcccacgcggggcgccgggccacctgggtctttgcgggctctcgcc

SEQ ID NO: 25884 - DNA, 81 bp, Homo sapiens
agtcgggtggtcgcgggccatggagggtagcttttcggatggcggagcgctgccggaggggctcgcggaagaggccgagcc

SEQ ID NO: 25885 - DNA, 72 bp, Homo sapiens
aggcccacagtcatccgtgcgctgcgcggcaaaccctgtcgcgagggcgccccgagttgctgcggggcctga

SEQ ID NO: 25886 - DNA, 64 bp, Homo sapiens
gtgggcggggagtcaggggcccagggcacgggtccagtcctgtccctgactggctagtccacaa

SEQ ID NO: 25887 - DNA, 54 bp, Homo sapiens
cgtggcggtcccgcccgggtgtcccgcggtgtcccgggtaggggccgcggcgag

SEQ ID NO: 25888 - DNA, 61 bp, Homo sapiens
gggccctggaggcaggcacagccagtgcccaaacctggctgtcttgctgctgggtgacctt

SEQ ID NO: 25889 - DNA, 50 bp, Homo sapiens
cggcggcacttgcccgacacggcatgcagggctggtgccacggccctggc

SEQ ID NO: 25890 - DNA, 75 bp, Homo sapiens
ggaccgaggtggcaggactcgggctggtgttagagggccctggggggccagaatgaggtgggccaacatggctgt

SEQ ID NO: 25891 - DNA, 66 bp, Homo sapiens
gtcagggcggcaggggcatccccagggcgcagggagcgcagggaccagctccctccagcctgacgg

SEQ ID NO: 25892 - DNA, 78 bp, Homo sapiens
atgtgtgcgtgtgtgcatgtgtgtgcatgtgtgcatgtgtgtgtgcatgtgtgtgcacgtgcatgtctgcatacgtgt

SEQ ID NO: 25893 - DNA, 82 bp, Homo sapiens; identical to SEQ ID NO: 12163

SEQ ID NO: 25894 - DNA, 66 bp, Homo sapiens
catgtattgattcacttaatctttaccacaactctaagaaaaggattaaatgagttaatacttgca

SEQ ID NO: 25895 - DNA, 66 bp, Homo sapiens; identical to SEQ ID NO: 25894

SEQ ID NO: 25896 - DNA, 63 bp, Homo sapiens
ggccgctttcgggggcggcggccacggagaaactccccgaccaccaccccggcggcggcacga

SEQ ID NO: 25897 - DNA, 67 bp, Homo sapiens
gccgccgccgccgccgccacggtagccgccatcttcttcctgccctcgccgtggcgggcgacggttt

SEQ ID NO: 25898 - DNA, 65 bp, Homo sapiens
ccacggcgcgagaaaccgtcgcccgccacggcgagggcaggaagaagatggcggctaccgtggcg

SEQ ID NO: 25899 - DNA, 56 bp, Homo sapiens
ggcatgatgtgggatgcccgtgggcacccacttggcactctcacatgcatagcctg

SEQ ID NO: 25900 - DNA, 64 bp, Homo sapiens
gcctactttctgcaccattcctatcaggaactttttagttttttggggtggagagggtgggctg

SEQ ID NO: 25901 - DNA, 75 bp, Homo sapiens
ggccgcgccccacctcgcgcctccgccaggcaccacccccgcgcctgcgcagaagggtcgtggcggcggcggcgg

SEQ ID NO: 25902 - DNA, 87 bp, Homo sapiens
cccgacgccggaagtgcctggagcgcgcgacagcggcggggcggggcggcctggaggctgtggcgcgcggccggcagagggagggga

SEQ ID NO: 25903 - DNA, 64 bp, Homo sapiens
gccgcctgcgcatgctccatcgcctgggtaggtttccagggaaggcagcgagcaggatccccta

SEQ ID NO: 25904 - DNA, 72 bp, Homo sapiens
ggcggcgcgggagctggggttggtgtttggcggcgccagagcagcggatcccggtctcgccgcagcagcagc

SEQ ID NO: 25905 - DNA, 82 bp, Homo sapiens
gcgccgggaagcgccggcggccatctccccgcccgcgcccgccgtgggaggagggggccgccaggcggcagggaccgtgcga

SEQ ID NO: 25906 - DNA, 73 bp, Homo sapiens
accagcaggcggggagcgcctggagcggggccgggtgctctgccctctccaggcgcggcgctgcttgctctgc

SEQ ID NO: 25907 - DNA, 75 bp, Homo sapiens
ggcgtcgcggccgccccctcccgcagcacgcccctgccccgcctggccgcggaggggaaggcatctggccgccca

SEQ ID NO: 25908 - DNA, 73 bp, Homo sapiens
cactcggagcggctggccggtgccaccggccccaggtggtgaggggcttagcacctgggccagtagctgtgga

SEQ ID NO: 25909 - DNA, 61 bp, Homo sapiens
gggcttggaagtaggtggggttgcgagccttatcagcaaccctctaatctcccaggccaca

SEQ ID NO: 25910 - DNA, 52 bp, Homo sapiens
cctcccgcggggggcttccgggcgcgcggcctcggagccccacggggagaca

SEQ ID NO: 25911 - DNA, 55 bp, Homo sapiens
gggttttgccatgttgcggatagtcttgaactagccgcaacatggcgaaacccca

SEQ ID NO: 25912 - DNA, 55 bp, Homo sapiens; identical to SEQ ID NO: 25911

SEQ ID NO: 25913 - DNA, 55 bp, Homo sapiens
gggtttcgccatgttgcggctagttcaagactatccgcaacatggcaaaacccca

SEQ ID NO: 25914 - DNA, 72 bp, Homo sapiens
ctgccaggtcgggaggcccctggtgcccatggtgctcttgtccatggggcttgggtgcatctgggccccgcc

SEQ ID NO: 25915 - DNA, 58 bp, Homo sapiens
aaacacacacacacatgccatttaaatatagatatatggggtgtgtgtgtgtgtgtgt

SEQ ID NO: 25916 - DNA, 62 bp, Homo sapiens
agatggggagaactcaatcttaaattcctaaatacatttaggattgagttctccccatctcc

SEQ ID NO: 25917 - DNA, 90 bp, Homo sapiens
ggccggcccgcggggggcggagggacggagggaagatggcggcaggggccggatattggcgccgcctcccccaatcccggagccggcgca

SEQ ID NO: 25918 - DNA, 58 bp, Homo sapiens
acctccattctgtcatgactgacaccatggtagtctgtcagcttgaccagtggagagt

SEQ ID NO: 25919 - DNA, 60 bp, Homo sapiens
gcggctggcgggccccggcgggcagggctggcggggaccggcggagcgcgccagcccagc

SEQ ID NO: 25920 - DNA, 57 bp, Homo sapiens
accaacctgggccaccacagccaagaaatcccagtggttcagttcagtgaaggtgag

SEQ ID NO: 25921 - DNA, 85 bp, Homo sapiens
ttcgagacctcagaagcctggacttcaaaccaaaatgctgatagtgatgtgaacagtgaagtccaggctgctgaggcctcagatg

SEQ ID NO: 25922 - DNA, 64 bp, Homo sapiens
gcgaccggctggccctgctggctccgggtaatgaggggcttagcacccgggccagtggctgtgg

SEQ ID NO: 25923 - DNA, 58 bp, Homo sapiens
tctccccgccccgcccctcgtctcctccaagatggcgagcggcggcagcgggggggtg

SEQ ID NO: 25924 - DNA, 67 bp, Homo sapiens
cacactgcgcaggagccggcgcgggaaggcggcggggctgtccttcccggtcagcgtcctacgcgtg

SEQ ID NO: 25925 - DNA, 79 bp, Homo sapiens
atagaacaaaaacagaagaaaaggccaatgagtccctctctttcctggaacccttcttctcctgcccttgaatatcaga

SEQ ID NO: 25926 - DNA, 105 bp, Homo sapiens
tggattgcctagaccagggaagccagttggcatggctcagtccaagtctgaccacctgaggaatgcctggactgagccgtgctactggcttccctggtctccagc

SEQ ID NO: 25927 - DNA, 73 bp, Homo sapiens
tgtgccttagtgtattaaactgagccttgggttttttcaagtttaagatcagtgttatgcaggggttgcagat

SEQ ID NO: 25928 - DNA, 64 bp, Homo sapiens
agtacagatcaaataatctggtactatatatgtatctaaagtacagatcaaataatctgtacta

SEQ ID NO: 25929 - DNA, 52 bp, Homo sapiens
agatagttactgctacccagagcaatatctgtgatgaagacagtgctacaga

SEQ ID NO: 25930 - DNA, 52 bp, Homo sapiens; identical to SEQ ID NO: 25929

SEQ ID NO: 25931 - DNA, 54 bp, Homo sapiens
actccggtggtaggggagcgcgctgctgtttagagccacgagttaccggagcgc

SEQ ID NO: 25932 - DNA, 71 bp, Homo sapiens
cagctgccttcaggccctgcgccgcctccggagtccatggccggcacgcgctgggtactcggggcgctgct

SEQ ID NO: 25933 - DNA, 55 bp, Homo sapiens
ccggcagagacagggcactggtttccctctaccagagttcctgacccagccgaga

SEQ ID NO: 25934 - DNA, 59 bp, Homo sapiens
tgccttttctagtgctgtccctgggcagaaaaggccatagacaccaccagaaaaggagc

SEQ ID NO: 25935 - DNA, 59 bp, Homo sapiens
gcggccccgggctcgggcggctgggatggagcagaagagcgcggagcaccggagggcac

SEQ ID NO: 25936 - DNA, 58 bp, Homo sapiens
acccgggctccgacagcggctgcaggtctccaagttgcggccgctggagcccgagcca

SEQ ID NO: 25937 - DNA, 53 bp, Homo sapiens
gcgggggctcgacgcgtctccgcggccggcgtcgacgcgctggggccccgctg

SEQ ID NO: 25938 - DNA, 75 bp, Homo sapiens
gcgccctccagctcgccggcgggaccatgaagaagttctctcggatgcccaagtcggagggcggcagcggcggcg

SEQ ID NO: 25939 - DNA, 75 bp, Homo sapiens
cgacgctgccgggtccgccgcggcgctggcggcagtggccggtgtgagcgcagagccgggccctgggcagcagcg

SEQ ID NO: 25940 - DNA, 65 bp, Homo sapiens
gggggcactatagcttggcagtgaccatttgccaagtggtcactgccaagccatagtgctccctc

SEQ ID NO: 25941 - DNA, 58 bp, Homo sapiens
cggcggccgcggggcccttgcagctgcagctgccctcggcgctcacgctgctgccgcc

SEQ ID NO: 25942 - DNA, 80 bp, Homo sapiens
accctcggctccgccgccggctccttgcgccttcggagtgtcccgcagcgacgccgggagccgacgcgccgcgcgggtac

SEQ ID NO: 25943 - DNA, 57 bp, Homo sapiens
gagcagcagcgttaggccggggtgtggctgcacctctgcgaaggctgtcgtgccccg

SEQ ID NO: 25944 - DNA, 75 bp, Homo sapiens
cagcgccatgctgggctcgcgagccgcggggttcgcgcggggcctgcgggctgtggcactggcgtggctgccggg

SEQ ID NO: 25945 - DNA, 60 bp, Homo sapiens
caatgcttagatccccccactggtgtttcactttaccagtggggagatctaagcattgag

SEQ ID NO: 25946 - DNA, 60 bp, Homo sapiens; identical to SEQ ID NO: 25945

SEQ ID NO: 25947 - DNA, 56 bp, Homo sapiens
atgcttagatctccccactggtaaagtgaaacaccagtggggggatctaagcattg

SEQ ID NO: 25948 - DNA, 81 bp, Homo sapiens
cggcaggcagggtcgggtagggggcagagcctgggcgccgacaagccctgctggtccccggccgagccccgcctgcgggct

SEQ ID NO: 25949 - DNA, 65 bp, Homo sapiens
cgactctatatacatagctgtatacacagctatgcatatacacagctatgtatatagagtcaggg

SEQ ID NO: 25950 - DNA, 56 bp, Homo sapiens
agcaaatgaaacagtagctccaacatcatggatagcgctactgtttcatttgctaa

SEQ ID NO: 25951 - DNA, 71 bp, Homo sapiens
ctcagattgcctcaatttttttgacaagataggaagtactgtaattggctgagagtggtgatttatggggt

SEQ ID NO: 25952 - DNA, 113 bp, Homo sapiens; identical to SEQ ID NO: 12423

SEQ ID NO: 25953 - DNA, 62 bp, Homo sapiens
ggagcggcccggcgacgcgctgacagcttcccctgcccttcccgtcggtcgggccgccagcc

SEQ ID NO: 25954 - DNA, 60 bp, Homo sapiens
gcgcggggaggaggccgaggccgcagcttgagggaggccccggcccctctgtacgcgtgg

SEQ ID NO: 25955 - DNA, 70 bp, Homo sapiens
ggcacgtgatccccgcgcgcagaggaaggtgggcgcgcgccgacgcagctgcctggggaacgcctgtgag

SEQ ID NO: 25956 - DNA, 63 bp, Homo sapiens
tggggctcagtggtaccaggactgaggaattatggaaacttgggctgttactgctgggacagg

SEQ ID NO: 25957 - DNA, 63 bp, Homo sapiens; identical to SEQ ID NO: 25956

SEQ ID NO: 25958 - DNA, 59 bp, Homo sapiens
ccgcgggcgcggggatcctgggtcgctccgccttgacccacgcgccccacgccccggga

SEQ ID NO: 25959 - DNA, 84 bp, Homo sapiens
aggcattagattctcataagaagcgggcaacctagatccctcccatgtgcagggttcctgctcctataagaatctaatgcccca

SEQ ID NO: 25960 - DNA, 96 bp, Homo sapiens
tgggggagtgaagagtagataaaatattggtacctgatgaatctgaggccaggtttcaatactttatctgctcttcatttccccatatctacttac

SEQ ID NO: 25961 - DNA, 80 bp, Homo sapiens
tgagacagagtttggagtctcgttctgtcgccaggctggaatgcagtggcgtgatctcggctcgctgcaacctctgtctc

SEQ ID NO: 25962 - DNA, 59 bp, Homo sapiens
ggggcgggggctgcgttctcacgtctccgagctcacgcgagtcgttgcccccaccctcc

SEQ ID NO: 25963 - DNA, 54 bp, Homo sapiens
gtgcggggcgggcgcggcgggccgggcgtccccgcccccgcaaccccccacccc

SEQ ID NO: 25964 - DNA, 81 bp, Homo sapiens
gtcttgctgtcacccaggctggagtgcagtggcatgatcacagctcactgcagcctcaatctcctgggctcaggcaaccca

SEQ ID NO: 25965 - DNA, 74 bp, Homo sapiens
aggggcggtgcggcggcgctcgggagacccgcgaggggccctggaggtcctcggcccgcgcgcgccgctcggga

SEQ ID NO: 25966 - DNA, 68 bp, Homo sapiens
gaggggtgctgcgccccgtggccctgcccgcttcatcgcggctgtccccgccccgccgcgccccccat

SEQ ID NO: 25967 - DNA, 65 bp, Homo sapiens
tggggcgggtggcggcggctcctggatgactgactgccccaggtgtcactgcttcccggcctgtt

SEQ ID NO: 25968 - DNA, 55 bp, Homo sapiens
cggcctcagtcacccgccgcgacgtgggaactggcggtgggtggccgagggctgc

SEQ ID NO: 25969 - DNA, 57 bp, Homo sapiens
gcgtccaggagtcgggactgggctcccgcctacggccgccctcccgccggggggcca

SEQ ID NO: 25970 - DNA, 106 bp, Homo sapiens
gactttatattgttgaacatcagactcaaggccaacaactgactacttcgaaaatgggaagtagacaattgttgatcttgggcctgatgttcaacaatataaagtt

SEQ ID NO: 25971 - DNA, 69 bp, Homo sapiens
gcggcgccaaatcgcgcagagggggacgcgggcacccgcccgcccccagcggcggcggccgggcctctg

SEQ ID NO: 25972 - DNA, 52 bp, Homo sapiens
tttgggatattggaataagttggaatattaacctattccaatatcccaaagg

SEQ ID NO: 25973 - DNA, 62 bp, Homo sapiens
ggattctaagtcaatggcactgcagtttgaagatgtggcagtgccattgacttagagtcacc

SEQ ID NO: 25974 - DNA, 55 bp, Homo sapiens
ggcctgctgagcctgggagcgccggcagcgcgttcccacgctcaggccgggtcgg

SEQ ID NO: 25975 - DNA, 66 bp, Homo sapiens
tttatgcaaaagtaattgcggtttttccattttgatgggaaaaccgcaattacttttgcaccgact

SEQ ID NO: 25976 - DNA, 70 bp, Homo sapiens
tggttgaatcacaaggacagaccaatagagcatgggttaatgggtctgtcctcatgattcaaccaccttt

SEQ ID NO: 25977 - DNA, 70 bp, Homo sapiens; identical to SEQ ID NO: 25976

SEQ ID NO: 25978 - DNA, 73 bp, Homo sapiens
aggtggttgaatcatgaggacagacccattaacccatgctctattggtctgtccttgtgattcaaccaccttt

SEQ ID NO: 25979 - DNA, 55 bp, Homo sapiens
cctcctccccgctgggacagccaactgggccggctgccagtgggggtaggagagg

SEQ ID NO: 25980 - DNA, 56 bp, Homo sapiens
ctggtttttaatctaatgccctgtttctgtcccaaggcattaggttaaaacccaga

SEQ ID NO: 25981 - DNA, 60 bp, Homo sapiens
ctcggggagactgtcacgggagaaagggaaggtggcactcccccggacaggctccccgcc

SEQ ID NO: 25982 - DNA, 60 bp, Homo sapiens
gcggggagcctgtccgggggagtgccaccttccctttctcccgtgacagtctccccgagc

SEQ ID NO: 25983 - DNA, 51 bp, Homo sapiens
cctcctcccgcgtctccgcccccgcggggccgctgggcgcccggggaggcg

SEQ ID NO: 25984 - DNA, 61 bp, Homo sapiens
gccccgccccgccgagcgcccggccgccctcctgtctgggcgcgcgtggctggcgggtggc

SEQ ID NO: 25985 - DNA, 98 bp, Homo sapiens; identical to SEQ ID NO: 12639

SEQ ID NO: 25986 - DNA, 76 bp, Homo sapiens
cagcggcgggaggggcgaggcgaggcgaggcgggagcctcgtgtgccagccgcagccccacacctgccgggatgtc

SEQ ID NO: 25987 - DNA, 55 bp, Homo sapiens
gtcctcggggaggagagggagccaggggcctccggggctccgggtgcggggacct

SEQ ID NO: 25988 - DNA, 62 bp, Homo sapiens
ctgtcaaccactggcacgcccttcgatcgtgagcagcaggaggcgtttgatgtggttgtaga

SEQ ID NO: 25989 - DNA, 76 bp, Homo sapiens
cgctgtggaaccgcctcctgctagagcagcgggctggcgacggtcctcgccggggcgggaagcggctcaggctgcc

SEQ ID NO: 25990 - DNA, 78 bp, Homo sapiens
gcgggggcggagggggaggaggagacggggcggggaggacccccaggtttccgagtctccgcccgggctttcgttccc

SEQ ID NO: 25991 - DNA, 63 bp, Homo sapiens
gcctgagaggtctctcgtcgctgcaggcgcctcagcccagccgcgtgccttggcccatggccg

SEQ ID NO: 25992 - DNA, 58 bp, Homo sapiens
gccggcgggaagggtccgcgcgccatggctggccgctcgcgccctttcccaccgctgc

SEQ ID NO: 25993 - DNA, 63 bp, Homo sapiens
cggcggcggcgcgccgcgtgcacagccggcgctcgttccagcggcctcgcgcgcgccgccgcc

SEQ ID NO: 25994 - DNA, 54 bp, Homo sapiens
ccccgtgccccagccgggtgcccaccatgggaaggcgaggggcacgcaggaggc

SEQ ID NO: 25995 - DNA, 55 bp, Homo sapiens
cgccgtccgagggctccgtttgaaacatggcgcgggctggccctcggctggtgct

SEQ ID NO: 25996 - DNA, 86 bp, Homo sapiens
agggtgggggctttgtggggacccccctcgcctcgccgtgcccgcccctgcactggctgtgagtccccggggaggccccttccgca

SEQ ID NO: 25997 - DNA, 51 bp, Homo sapiens
gggtggggacggggctggggagagaatcccccagccctgttccctccatcc

SEQ ID NO: 25998 - DNA, 71 bp, Homo sapiens
ccccgcccctgcctccaagtcccgtggcgtcggcgggagcggcgcagcgcgggccgggccgggacggggac

SEQ ID NO: 25999 - DNA, 76 bp, Homo sapiens
ccaccccccgtccccgccccatccgccctaccggcacctgcggtggcctgggcggggcggggctccgcttacctgg

SEQ ID NO: 26000 - DNA, 51 bp, Homo sapiens
ggagacatctaggctttccacagtcaagggtggaagccctaggtgcgaggg

SEQ ID NO: 26001 - DNA, 55 bp, Homo sapiens
cccgtgccggcccggccagctactctcgcggtgggcgcgcgcgtcggggcggcgg

SEQ ID NO: 26002 - DNA, 67 bp, Homo sapiens
agagaccacactttgagccactgcctcctcagtgacttttaaggcagtagttctaaagtgtggtccc

SEQ ID NO: 26003 - DNA, 67 bp, Homo sapiens; identical to SEQ ID NO: 26002

SEQ ID NO: 26004 - DNA, 80 bp, Homo sapiens
tagattcagaactcgtgttcaaagcctttagcccagcaatgggagagtgctaaaggcttcaagcacgagttctgaatcta

SEQ ID NO: 26005 - DNA, 67 bp, Homo sapiens
ttccttgacctgatgctgtagggcttggcaactcttgtgaaatttcatagatctcgtcgcttactgg

SEQ ID NO: 26006 - DNA, 64 bp, Homo sapiens
tgaggacaggagggtgggagtctttacagtgacaaattttggctcccactctcctgtccccacc

SEQ ID NO: 26007 - DNA, 69 bp, Homo sapiens
gggacgcagaagcgagaagcggggacctcggcgcgcgccccgcgtcccgctcttcctgcccgcgccccg

SEQ ID NO: 26008 - DNA, 55 bp, Homo sapiens
tcccaaatgtccaactgtccactggatatctccatgtagacatctgacaggacac

SEQ ID NO: 26009 - DNA, 67 bp, Homo sapiens
gggcaccgggtttgctgcgcagggggcgtgacagggcgtccccggtaccccagcggcggcgcctcct

SEQ ID NO: 26010 - DNA, 64 bp, Homo sapiens
gccgcagctgctggggccgccactgtggccgctgccgccactgggggccccgccgccgccgctg

SEQ ID NO: 26011 - DNA, 84 bp, Homo sapiens
atatgtacatacggctatgcgtatatgcatatgtgtgtatgtacctacgggtatgcgtatatgcatatgtgtgtgtatgtatat

SEQ ID NO: 26012 - DNA, 63 bp, Homo sapiens
ttttacatatgctgaggagtgttttacttccaattttgtggtcaattttagcataagtgtgag

SEQ ID NO: 26013 - DNA, 62 bp, Homo sapiens
tcttgggccccacccctggagattgtgaatcagtaagtagatctggggtggggcctgggaat

SEQ ID NO: 26014 - DNA, 62 bp, Homo sapiens
gcaacacctcctggatctatggaagctgcctggaagtcccatggccagggaggcactgtcac

SEQ ID NO: 26015 - DNA, 83 bp, Homo sapiens
cacaccaagtccagctaccactactttctccatctatcctgtatcctccaccgtacagccagtagcagctgcggctactgtgg

SEQ ID NO: 26016 - DNA, 55 bp, Homo sapiens
gagagaagctgtcggggacctggggcagtgagcctgtaccccgtggcttctcaca

SEQ ID NO: 26017 - DNA, 60 bp, Homo sapiens
acttgcgcatctgtggatctggtattctagtattcattagatccacagatgcgcaagtcc

SEQ ID NO: 26018 - DNA, 72 bp, Homo sapiens
cgcgggcggccgctctccgggatgcgggttcgaggcccgcgtgctgaaggggagagcggggccaccggcgcg

SEQ ID NO: 26019 - DNA, 80 bp, Homo sapiens
cggggagggcgaagaggggctgccgagtggcctcagagtgaggggtttgaggattcgttggtgccctcgccgcccccgcc

SEQ ID NO: 26020 - DNA, 53 bp, Homo sapiens
ttgggctcgcgtcctcggccgcgccgcgcggcacccgggcccagcagccggga

SEQ ID NO: 26021 - DNA, 83 bp, Homo sapiens
cccgagctaccgggggggcatcgccgcgggcccgggaaccaattctcctgtcggcgggggcgtccctccctgcggcttggtgg

SEQ ID NO: 26022 - DNA, 64 bp, Homo sapiens
atgcaatgtgagccgcgtggcaatccaatataggggcatagccagcgcttatttggcctggatg

SEQ ID NO: 26023 - DNA, 54 bp, Homo sapiens
caggtgagcgcgacggcactggcgggtgcgggcagccggggcgcgcgcctaggg

SEQ ID NO: 26024 - DNA, 56 bp, Homo sapiens
gtggcagtagccgtgacaccagtggctttgggtgaggtcacggcgcctgccagccg

SEQ ID NO: 26025 - DNA, 56 bp, Homo sapiens; identical to SEQ ID NO: 26024

SEQ ID NO: 26026 - DNA, 50 bp, Homo sapiens
ccgcgggcggcggcagccgtgcccaggctgctgcagcgccgcccgcccgc

SEQ ID NO: 26027 - DNA, 80 bp, Homo sapiens
cgagccgtgaggggtgtgcgcgcgtgagccggagcggggctcgcccctcgccggcgcccgccgcccagccggtgattgct

SEQ ID NO: 26028 - DNA, 79 bp, Homo sapiens
gagccagcgggagaggattagggctcccgaggcaacttgctcggggctcaggccgttctcccccgaagctcgggctgcc

SEQ ID NO: 26029 - DNA, 91 bp, Homo sapiens
ctgtgtgtgatgagctggcagtgtattgttagctggttgaatatgtgaatggcatcggctaacatgcaactgctgtcttattgcatataca

SEQ ID NO: 26030 - DNA, 68 bp, Homo sapiens
cacgcgccgcgccgccaggtagtcccggccgcaccggcgacaggaggagccttggcggcagcgctgcg

SEQ ID NO: 26031 - DNA, 56 bp, Homo sapiens
gccacaggccccgcagcagacggccaggcatggctgccccgcggggccgtgaccag

SEQ ID NO: 26032 - DNA, 71 bp, Homo sapiens
cgtcttccccagctctaagctcccgaagctgcgccgcagctcctccgagcttcaagctgcggaagacgctg

SEQ ID NO: 26033 - DNA, 68 bp, Homo sapiens
ccgtgcgcacagagcagccttctgagtagctggggttactcctggaaggctgctctgtgcccacagtc

SEQ ID NO: 26034 - DNA, 68 bp, Homo sapiens; identical to SEQ ID NO: 26033

SEQ ID NO: 26035 - DNA, 74 bp, Homo sapiens
ctcccagcgccagctttgtctccccgccggtatgaggctgagacttggaggaggctgagctgcgccgctgggga

SEQ ID NO: 26036 - DNA, 53 bp, Homo sapiens
gcgggcgtgggaagctgcaccgcgctgccgctgtggtttcctgcgacctgacc

SEQ ID NO: 26037 - DNA, 71 bp, Homo sapiens
acatctgtcagtctgagtgactggtcttataaagtgacctttgagaccagtcattcagactgacagatgtt

SEQ ID NO: 26038 - DNA, 71 bp, Homo sapiens; identical to SEQ ID NO: 26037

SEQ ID NO: 26039 - DNA, 62 bp, Homo sapiens
ggggggcggaaggcgagggcggtggcaggaagggtccgccaggcctgagctcgctcccccac

SEQ ID NO: 26040 - DNA, 66 bp, Homo sapiens
tgagcccgggtagggccaggtggctgccctttcacctagggtagtccctggtcgcctccgctcttc

SEQ ID NO: 26041 - DNA, 62 bp, Homo sapiens
atgtgctaccctgcttggcttgttttaaaaatgcatttcaaggcagacgcggtggctcacgc

SEQ ID NO: 26042 - DNA, 65 bp, Homo sapiens
ctccttgcgctcggcggccgcggcggcagcagcagcagacgctggcggccgggctgccaggagca

SEQ ID NO: 26043 - DNA, 50 bp, Homo sapiens
gcgtcctcctgccgcgtcccgcctgggtgaggtccggcgggcgaccggtc

SEQ ID NO: 26044 - DNA, 61 bp, Homo sapiens
gggagggcgaggcccggctgcctgcgctcgcgttcccaggccctcggaaccgcgcgccctc

SEQ ID NO: 26045 - DNA, 56 bp, Homo sapiens
gtgaagcggagcagcccgaggcggggcagcctcccggagcagcgccgcgcagagcc

SEQ ID NO: 26046 - DNA, 59 bp, Homo sapiens
gctaatttatctccaccagttggatataaattatccagcttgtggagataaattagcat

SEQ ID NO: 26047 - DNA, 57 bp, Homo sapiens
agcagcaccctcttctctgccagccggccggccggcggaggcggaggcagcggcagg

SEQ ID NO: 26048 - DNA, 68 bp, Homo sapiens
cccagccccgatggccctgcccagtcccagacagaacctactatgtgcggcggcagctggggcgggaa

SEQ ID NO: 26049 - DNA, 76 bp, Homo sapiens
agcggtgggcgaggaggtggcagcggtgtgcaaggagggcctgatgggtcaagatcctctttgcccaccgccctgc

SEQ ID NO: 26050 - DNA, 55 bp, Homo sapiens
ctgggagcgggtggagaggagggaagcgagacctccccgccgcccgcgaccaccc

SEQ ID NO: 26051 - DNA, 53 bp, Homo sapiens
aggcgtgagttagccaggtgtctagtacaggctagtacaggctgcatgcttgt

SEQ ID NO: 26052 - DNA, 68 bp, Homo sapiens
tgctgccaccagataaatacatgatgacctcttctttacaggtcaggtgtttatctggaggcagcatg

SEQ ID NO: 26053 - DNA, 77 bp, Homo sapiens
gctcctgcttttgaaagccaattatagtgataaaagagggaaagggatgaaggtgaatagtgaaagggcaggatacc

SEQ ID NO: 26054 - DNA, 57 bp, Homo sapiens
ccgtgcccgtgggcggaggacataggctgtgggtgtgtcccgcccgcaggcgcgcgt

SEQ ID NO: 26055 - DNA, 78 bp, Homo sapiens
tgtcaggggtgtgggcacgggggtgcggggaggcggtgcaggaatccgtcccgccgagtgccgtcggcccctgtgggc

SEQ ID NO: 26056 - DNA, 61 bp, Homo sapiens
ggtgcccacgacgcacggtccagggtccgagggcggctgggccggcggactgggcatccag

SEQ ID NO: 26057 - DNA, 59 bp, Homo sapiens
aggactggcaggcatccaggcgccaggcggagcgctgagggaggctcccgccggccgaa

SEQ ID NO: 26058 - DNA, 60 bp, Homo sapiens
cagtcagctgggccgcctcagctctcggagtaggaagctcgggcgctccggctgtaagga

SEQ ID NO: 26059 - DNA, 52 bp, Homo sapiens
atgagaagatgttttccaggttttctgaaaccttttatagtttttatttgta

SEQ ID NO: 26060 - DNA, 84 bp, Homo sapiens
attaggttggtataaaattaattgcagtttttgtcattactttcaatagcaaaaactgcagttacttttgcaccaatgtaatac

SEQ ID NO: 26061 - DNA, 71 bp, Homo sapiens
ggctgcgggcaggtgggcgggaggcggcagcggtggcggggcggcctcctcctcctcctcccgcgcgtcat

SEQ ID NO: 26062 - DNA, 57 bp, Homo sapiens
cccaatggcaacttacaactgctattgacatgaaggcagttgtggtgtatttgttat

SEQ ID NO: 26063 - DNA, 52 bp, Homo sapiens
gccctgggagtggagacgcggagctgcggtcgccgctttctgggctcgctca

SEQ ID NO: 26064 - DNA, 52 bp, Homo sapiens; identical to SEQ ID NO: 26063

SEQ ID NO: 26065 - DNA, 55 bp, Homo sapiens
tgctaagtttagttttctattgcgtagagtctctgtagtactgatattaaacttg

SEQ ID NO: 26066 - DNA, 50 bp, Homo sapiens
cggcggccactgggcatgctccgttgtcaggcaagttcggggctgcaggc

SEQ ID NO: 26067 - DNA, 82 bp, Homo sapiens
ctgattccagatttgcctgcttcagacagttctgttatcaaagaaacagttctgtttgaaacaggcaaatctggagtcagcc

SEQ ID NO: 26068 - DNA, 64 bp, Homo sapiens
tttccccagccttgtctagacatggaccatgcaagtccatgtccagacaaggtttggggaaatc

SEQ ID NO: 26069 - DNA, 56 bp, Homo sapiens
cgggtcggcgcgggcccagccgtgcgtgctcacgtgacgggtccgcgaggcccagc

SEQ ID NO: 26070 - DNA, 56 bp, Homo sapiens
gcggggcggcccggccgtgggcggagcggcggccgcggccgtgagcctgcccccaa

SEQ ID NO: 26071 - DNA, 55 bp, Homo sapiens
gacgtgtccaggtccgcggccccgggagcttggcgcggcccggcctggatgcgct

SEQ ID NO: 26072 - DNA, 58 bp, Homo sapiens
tcgaggcctcccgggcaggcctggcggagggaggagcgaggcctgcctgcgggagacc

SEQ ID NO: 26073 - DNA, 66 bp, Homo sapiens
gaggccgggccggagccgcaggccagccgcgattccttcgggcgatgctgggggctttccggtcgg

SEQ ID NO: 26074 - DNA, 68 bp, Homo sapiens
tggctggccgcgctcttcgcacggggcgcttttgcgtggggtcgcgcaggagccgcggagggccggat

SEQ ID NO: 26075 - DNA, 68 bp, Homo sapiens; identical to SEQ ID NO: 26074

SEQ ID NO: 26076 - DNA, 88 bp, Homo sapiens
aggactggaaggtggctagggatgtgtagcgggagaagggtcagtctcgatcttcccctgtgaagctgtcagcgaccatcagagggta

SEQ ID NO: 26077 - DNA, 77 bp, Homo sapiens
gcggcggcggcggctgcggcggcggcggctcctcctcagagtccggctcaggctccggctgcggctccagcccgcga

SEQ ID NO: 26078 - DNA, 59 bp, Homo sapiens
cggcggcgggagaagccgcggagccgcccctgcccccgcccgcgggaccggcctccccg

SEQ ID NO: 26079 - DNA, 67 bp, Homo sapiens
cagactgggctgggctgtgggaagcattccccttcaggggagtttccacagctcagcccaggctcca

SEQ ID NO: 26080 - DNA, 67 bp, Homo sapiens; identical to SEQ ID NO: 26079

SEQ ID NO: 26081 - DNA, 76 bp, Homo sapiens
gggactgtcactgggcgtgccattgggccttctgtggtgagaggggaggagggcaaggcctgttctcagatccctg

SEQ ID NO: 26082 - DNA, 58 bp, Homo sapiens
tcctcggctgcggcgggcaccatggtcggtggcgaggcggctgccgcagtggaggagc

SEQ ID NO: 26083 - DNA, 59 bp, Homo sapiens
tcccccccctctccgcgctggcttcctagaacaggcagccagcaggagagagagggagc

SEQ ID NO: 26084 - DNA, 59 bp, Homo sapiens; identical to SEQ ID NO: 26083

SEQ ID NO: 26085 - DNA, 84 bp, Homo sapiens
acgtgcagccggtccggtcccagacaccttccgggggccaccgcctccgccctgtcgccccctctcccggcccggtgcacgcgg

SEQ ID NO: 26086 - DNA, 56 bp, Homo sapiens
tgcgcggcggccgcggcgggtgctgggagccagcgcctgcctcgccgccgccctcg

SEQ ID NO: 26087 - DNA, 56 bp, Homo sapiens; identical to SEQ ID NO: 26086

SEQ ID NO: 26088 - DNA, 77 bp, Homo sapiens
tgagggcgcggcggcgcgggcggcttggggctggattccgcccgcgctccctcgctcgctcgctccctccccagccc

SEQ ID NO: 26089 - DNA, 60 bp, Homo sapiens
cagagtccttgtgtgttttcagcccttctcagtctggggctgaacacacaagactctgtg

SEQ ID NO: 26090 - DNA, 55 bp, Homo sapiens
tgccgccgcgggagccgaggccgaggctgaggccgcagtgtccgcgaacagcagc

SEQ ID NO: 26091 - DNA, 53 bp, Homo sapiens
gagccttcgacgcagtgagcacgaactgagcaggcgctgcagcccgggctccc

SEQ ID NO: 26092 - DNA, 80 bp, Homo sapiens
cgggctgggcgcgaagagaggaccggcttggcggctcggtgctgccccctggaggttccctctccactcccagccccgga

SEQ ID NO: 26093 - DNA, 65 bp, Homo sapiens
ggagtggagagggaacctccagggggcagcaccgagccgccaagccggtcctctcttcgcgccca

SEQ ID NO: 26094 - DNA, 63 bp, Homo sapiens
gtctacttcaaattcctcccttaggggccttcaggactgttagggtgagatgtgagctggtgt

SEQ ID NO: 26095 - DNA, 70 bp, Homo sapiens
agctggttggcattctggccctggttcatgccaactcttgtgttgactaccccaggatgccagcatagtt

SEQ ID NO: 26096 - DNA, 70 bp, Homo sapiens; identical to SEQ ID NO: 26095

SEQ ID NO: 26097 - DNA, 65 bp, Homo sapiens
tcgtccagggaaccggtgcgcaggagcagccgggggcgcggcgcgccggccgcccttgggggact

SEQ ID NO: 26098 - DNA, 71 bp, Homo sapiens
ggtgcaaaagtaattgtggtttttgcattttttttttaaatggcaaaaacagcaattacttttgcaccact

SEQ ID NO: 26099 - DNA, 59 bp, Homo sapiens
cccggccgcgcgccgcagttcgggcgccttcgggcaggatcgcccagcggggccgcgtt

SEQ ID NO: 26100 - DNA, 80 bp, Homo sapiens
cgggctggctttagctcagcggttacttcgacagttctttaattgaaacaagcaacctgtctgggttgttcgagacccgc

SEQ ID NO: 26101 - DNA, 80 bp, Homo sapiens; identical to SEQ ID NO: 26100

SEQ ID NO: 26102 - DNA, 74 bp, Homo sapiens
gaccatgttggagacagaagaaggaatcctactgctggtcagagccatggatcctgctgttcccaacatgatga

SEQ ID NO: 26103 - DNA, 56 bp, Homo sapiens
tatccagttccgcaattcacactcgttgccaaagagtggggagcgggaatggatac

SEQ ID NO: 26104 - DNA, 50 bp, Homo sapiens
ttgggagcaggaaggtttgctcagggggtggctgggtgctgctcccgata

SEQ ID NO: 26105 - DNA, 58 bp, Homo sapiens
actgcctggtgctgtccctgagcaagggcaggacagggacagctgtgacaggaagtac

SEQ ID NO: 26106 - DNA, 70 bp, Homo sapiens
aattgaactgctctatgctactgttctttaaaacataggtaataagagtagcacagaatagttcagttgc

SEQ ID NO: 26107 - DNA, 63 bp, Homo sapiens
gctgtgctacagtgttctggtgtcacgcttatcaaccagtgcgagctgcactctagcacctcc

SEQ ID NO: 26108 - DNA, 81 bp, Homo sapiens
ctccgggcctctgcggagccctgggcagctctgagctcgcggaggcgtggccggtgcgcggggcccgcggcgcgcggggat

SEQ ID NO: 26109 - DNA, 80 bp, Homo sapiens
tccccagtggtctagcccttgagaaatgctgctcctaagagaagggagtgcagcacaccaagggggaacccctggggacc

SEQ ID NO: 26110 - DNA, 80 bp, Homo sapiens; identical to SEQ ID NO: 26109

SEQ ID NO: 26111 - DNA, 68 bp, Homo sapiens
gaaagcaaattcacagggagcaactgatccattccacaacagaatgctccctgtcaattcgctttcca

SEQ ID NO: 26112 - DNA, 68 bp, Homo sapiens; identical to SEQ ID NO: 26111

SEQ ID NO: 26113 - DNA, 76 bp, Homo sapiens
gactcccagactagcttctttggggactagggggttggtgtgtctcgtggcctcccccaggctggcctggctgcag

SEQ ID NO: 26114 - DNA, 66 bp, Homo sapiens
cgcgcgtcccggcgcgccgggctcctggggcctcaccacctcgcgcgcccagggcgcaccaccggc

SEQ ID NO: 26115 - DNA, 65 bp, Homo sapiens
agccagggcaggccgggcctccggtggccaaggtctcggaggccaggatgcctgccctggcatgc

SEQ ID NO: 26116 - DNA, 68 bp, Homo sapiens
acctctgagctcactcgctggttgctggcaggccttagtcctcaacagctgtgggccagaggcttcag

SEQ ID NO: 26117 - DNA, 58 bp, Homo sapiens
gcctcctttctgcgggccgggcccgtggtcacccggcctggacggagagaggaggtga

SEQ ID NO: 26118 - DNA, 142 bp, Homo sapiens; identical to SEQ ID NO: 13100

SEQ ID NO: 26119 - DNA, 61 bp, Homo sapiens
ctgtgaggttggcactgttgtatatcagacaatgccagacaacaatgccaacctcacagga

SEQ ID NO: 26120 - DNA, 86 bp, Homo sapiens
ggctgggcaacatagcgagacctcaactctacaatttttttttttttaaattttagagacggggtcttgctctgttgccaggcttt

SEQ ID NO: 26121 - DNA, 70 bp, Homo sapiens
tgcgactccgtgcgtgttcgctctgcctgtgaggtcgcgggaagcagcgcgcaggagcagaagtaacagg

SEQ ID NO: 26122 - DNA, 58 bp, Homo sapiens
aggcccagccagcaccgcgcgttgcgttcccgctaccgccgggctgggaagggcggga

SEQ ID NO: 26123 - DNA, 71 bp, Homo sapiens
tggacccgccgcagagccaggtaagcggccctcgcaggcctcgggccgggcacggggactaggatgccgcc

SEQ ID NO: 26124 - DNA, 56 bp, Homo sapiens
agggttgagggtggggaggagattgactgtgttttcctctcattccttggctcagc

SEQ ID NO: 26125 - DNA, 83 bp, Homo sapiens
gagggctgggagccgggtggggaggcgcggggcgagccggggggttccagacgcgcctccaccgccgggcagtgggcaggtat

SEQ ID NO: 26126 - DNA, 76 bp, Homo sapiens
gcagacagctccaggtcctccggccgcaggcgacgaaggcagagcggctggagagcgcggagccccggcggagagc

SEQ ID NO: 26127 - DNA, 75 bp, Homo sapiens
ccggtaggtgtaggcgcagccgcccaggcgacggcggcggcggcgtcggcggcggccgcggccgcggcactggca

SEQ ID NO: 26128 - DNA, 59 bp, Homo sapiens
tcacacatattttccatgcagttgcaaccatgtactgcagtgaaaatatgtgtgggggc

SEQ ID NO: 26129 - DNA, 62 bp, Homo sapiens
ccctcattatgttggtgaccacaattataacaataattatagtcaccaacataatgagagca

SEQ ID NO: 26130 - DNA, 79 bp, Homo sapiens
cacggcgctctgtgtgtgtgtgtgtgtgtgtgtgtgtgtgtgtgtgtttgtgtgtgcgcgcgcgcgcgtgtgttgtgcg

SEQ ID NO: 26131 - DNA, 62 bp, Homo sapiens
aaattattgttattactgagtgtaaaatttattttaaccctgtctgtagtggctaagtttca

SEQ ID NO: 26132 - DNA, 63 bp, Homo sapiens
agttgcttatgtcaggtgagaggggtagacaccaattctctctcacctggcataagcaattca

SEQ ID NO: 26133 - DNA, 68 bp, Homo sapiens
gggagagaggagggagatcttggagcaggaatgtctgtgagctcaggatccaccgctatcactcgccc

SEQ ID NO: 26134 - DNA, 78 bp, Homo sapiens; identical to SEQ ID NO: 13146

SEQ ID NO: 26135 - DNA, 60 bp, Homo sapiens
aggcctttggcacttagaggaacatatgacaaatgatttctctaagtgccaaagacctgt

SEQ ID NO: 26136 - DNA, 64 bp, Homo sapiens
ggcagtgcagaagggaaatgtggggtcagagctccctcacagagtcccttctggaacattgcct

SEQ ID NO: 26137 - DNA, 61 bp, Homo sapiens
cagacacaggtatggctggctccaaaatttgtgcctggagtcagacaacctgggttccaat

SEQ ID NO: 26138 - DNA, 63 bp, Homo sapiens
cgagtggccgtccagccgcacgttcttgcctttggcctgcgcgtggaagcgcggcgcctcgcc

SEQ ID NO: 26139 - DNA, 70 bp, Homo sapiens
ggtgcaaaagtaatggcggtttttgccattactttttaaaatggctaaaaccgccattacttttgcaccg

SEQ ID NO: 26140 - DNA, 74 bp, Homo sapiens
gccccgggccggtcgcgccgcccttgtccccggagtgaactctccctctgtgcgcgcagctgatggcggggcgc

SEQ ID NO: 26141 - DNA, 73 bp, Homo sapiens
actcctggactcaagcggtcctcccaccttgacctccccaagtattcggattataggtatgagccactgagtt

SEQ ID NO: 26142 - DNA, 65 bp, Homo sapiens
gtgctcatgtccctgaagcagacgccactgtcccgctaggtgcctgctaggtgcatggccacaga

SEQ ID NO: 26143 - DNA, 70 bp, Homo sapiens
cggctcgggtgacagcgtcgcggccgccggacgcagcgcggggcaggcgcgggcagagccgagcgcagcg

SEQ ID NO: 26144 - DNA, 52 bp, Homo sapiens
cccggtggcggagaggaagtgcggtccgcgccaagcccgtccccgccgacgc

SEQ ID NO: 26145 - DNA, 66 bp, Homo sapiens
ccagggggggcaggaggtgtcggctggggccaggccaggctgctgacggcccccctcccctccaca

SEQ ID NO: 26146 - DNA, 87 bp, Homo sapiens
cgccggggcggcccttcctgatgccggggtgtgtctctcgcgacgcgggggtgggctccggacgccggggctggccttgccgaagtc

SEQ ID NO: 26147 - DNA, 51 bp, Homo sapiens
aggaggcggcggcggaataggccggggcaggtcgcgctcgctgccttctcc

SEQ ID NO: 26148 - DNA, 55 bp, Homo sapiens
gacgcggggggaggggggtgcggcgagcggccccgctctctccccaccgctccgc

SEQ ID NO: 26149 - DNA, 68 bp, Homo sapiens
cgagcctggcggcgggtgtgcgccgagccccggcccggcccggccctcgcgtgcctcccaggctccgc

SEQ ID NO: 26150 - DNA, 50 bp, Homo sapiens
aagaggtcggggaacggctgcgaggccgcagcctcctccctgtctctccc

SEQ ID NO: 26151 - DNA, 61 bp, Homo sapiens
ggtgggggtggggggctggagctgccgctgtcctctgctgcaggcgccccacttccaccca

SEQ ID NO: 26152 - DNA, 89 bp, Homo sapiens
ctggcttgtggagttctgggatactgaggggaggggacagggcatgggagtgcggtgctctcacctttgacttgaactcattccccagg

SEQ ID NO: 26153 - DNA, 56 bp, Homo sapiens
aggctggcctggagggcaggccagagattggggctgccatctggtgccagcctttg

SEQ ID NO: 26154 - DNA, 58 bp, Homo sapiens
ctggggaggacagccatgacaggaagtggaactcacccgcttcgctgcccttcccaga

SEQ ID NO: 26155 - DNA, 58 bp, Homo sapiens; identical to SEQ ID NO: 26154

SEQ ID NO: 26156 - DNA, 61 bp, Homo sapiens
aaggagagcccagggtcccttctggggctgaccaaggagatcaccatgggcttgaccttca

SEQ ID NO: 26157 - DNA, 65 bp, Homo sapiens
cggggacggcgggcgcctcagcctgcggtgacccggcgcatcttggcgcggccgccgccgccgcc

SEQ ID NO: 26158 - DNA, 63 bp, Homo sapiens
cctcggggggctgggagcgcctctgcggctgaggggtcgggcgtggccggcgactgaggggtc

SEQ ID NO: 26159 - DNA, 68 bp, Homo sapiens
ggtccgccgctggcccggaggccctaggagctggtgctgcccccgcccgccgggccgcggaggaggca

SEQ ID NO: 26160 - DNA, 61 bp, Homo sapiens
ctggcccccgccctccgcgtgcgcccagcgctcttgcaggcggagggtgcgggccgatccc

SEQ ID NO: 26161 - DNA, 52 bp, Homo sapiens
cagcctcggccccgcgggcgcccgccgcgcacccgaggagatgaggctccgc

SEQ ID NO: 26162 - DNA, 60 bp, Homo sapiens
gccggcgacggcggtgctgcggcccctttaaatccgggccgccccgccctgcgccgtcga

SEQ ID NO: 26163 - DNA, 69 bp, Homo sapiens
ggggtgggctcagggtggcaggaaccttgacccgctcactgcctgccgctctgctaattcctcccccag

SEQ ID NO: 26164 - DNA, 78 bp, Homo sapiens
ggggaggccagtgttgtgggcttcctgctgggactgagaaggctcacgaagggcatccgcaatgttggtttcactgag

SEQ ID NO: 26165 - DNA, 52 bp, Homo sapiens
ggcggcgggcggcgggcgggtccggttccggcccggcctcggcgcgtcgcgg

SEQ ID NO: 26166 - DNA, 62 bp, Homo sapiens
gggcggtcgggcggcggcggcggcggcggcggcggcggcggcggcggcgggcggcgccccgg

SEQ ID NO: 26167 - DNA, 50 bp, Homo sapiens
cccggcttccgggtaggcagcccccagccgcctgccttgccagccggtgc

SEQ ID NO: 26168 - DNA, 70 bp, Homo sapiens
gctcgatcttgggacccaccgctgccctcagctccgagtccagggcgaggtaagggctggagtcgggcag

SEQ ID NO: 26169 - DNA, 85 bp, Homo sapiens
ctgcttccgagaaagctcgcagaagcgttcgtgcgcaggcgcggaagccccgcacagcacgcggtgggcccggttcgggggggcg

SEQ ID NO: 26170 - DNA, 75 bp, Homo sapiens
cgcacccagctcggagcccggagcgtgcctcggcggcctgtcgggtaaggccgggcctcggagcggtggcgcggg

SEQ ID NO: 26171 - DNA, 59 bp, Homo sapiens
accaggcaagaactactgtctcgtcgcaacttgaggagacaatatttcttgcctggttt

SEQ ID NO: 26172 - DNA, 51 bp, Homo sapiens
tggctgccctgtcgccctttgtgccgcgagaccccgatcctgggggccagc

SEQ ID NO: 26173 - DNA, 69 bp, Homo sapiens
tgtctcaattctaggactggttgccataaaggaagcccacgacatagagaccaggcttaatgaggtgga

SEQ ID NO: 26174 - DNA, 67 bp, Homo sapiens
cggggctgcgagtgtcggggcggggggcgcgggccgggtcgagcaccgccccgacgagggcccaggc

SEQ ID NO: 26175 - DNA, 51 bp, Homo sapiens
gcgcggcggagggcggcgcgagggcgcggctgcctccgctctgcccgcagc

SEQ ID NO: 26176 - DNA, 63 bp, Homo sapiens
ccgcgccgcccgcacgccgccgcgcccgccccagcccgcccggccccgcggcggggcgcgatg

SEQ ID NO: 26177 - DNA, 65 bp, Homo sapiens
ccccggcgggccggctcgcgctcgggctcatcgcgccccgccgcggggccgggcgggctggggcg

SEQ ID NO: 26178 - DNA, 80 bp, Homo sapiens
ttcttgcctaccacctctctctcccaccagcaccagaagtgccaggggtgggggcaggtcgggggggtgggcagcggatc

SEQ ID NO: 26179 - DNA, 56 bp, Homo sapiens
caaaaggcctcgcatggctccagcggctatgtggatccatgcaaggccttttgggg

SEQ ID NO: 26180 - DNA, 69 bp, Homo sapiens
tggagttgatgtcacgtccggcggcggcggcagcggcagcggcagcggcgctgagttttgtctcccggg

SEQ ID NO: 26181 - DNA, 57 bp, Homo sapiens
caccgcccagggcctgccgcgggctcgcgagcggaggtggcaccggtccgcggtgcg

SEQ ID NO: 26182 - DNA, 62 bp, Homo sapiens
gccgcgagcccaggccccggggcgctctaggacccgtcggcccggggcgtgcggagcggctc

SEQ ID NO: 26183 - DNA, 73 bp, Homo sapiens
gaggtgcgtctgcagtcccgggttcgggccctagtagtcggtggctggtcggtgactgggaccagaccgtcgc

SEQ ID NO: 26184 - DNA, 66 bp, Homo sapiens
cgcggcttcgggcgcctcgcagcccgcctgctcctgcagctctgcaccggagccggaggccgcctc

SEQ ID NO: 26185 - DNA, 53 bp, Homo sapiens
tcagctctacaactcagtgtcttgtttttaggtagtgagttgtagagctggaa

SEQ ID NO: 26186 - DNA, 60 bp, Homo sapiens
cactcacttcctgttctgtggcctgttaggaatcgggccacacagcagagggtgagcagc

SEQ ID NO: 26187 - DNA, 72 bp, Homo sapiens
gagatccgacttttttaacattgtggtgtcagaacttacaccgaaagatacttaacagattaggagaactca

SEQ ID NO: 26188 - DNA, 55 bp, Homo sapiens
tttctcaggtgtttgcaacagtgttctaactattaacgctacgatgcctgaacct

SEQ ID NO: 26189 - DNA, 72 bp, Homo sapiens
tgtgtgtgtgtgtgtgtgtgtgtgtgtgtgtgtgtgtacatgtgtacatgtgcacactcgcacatgcacata

SEQ ID NO: 26190 - DNA, 57 bp, Homo sapiens
cgctgcgggctggagagctgctgttggaacagggaggagttctccgggccgcaccct

SEQ ID NO: 26191 - DNA, 57 bp, Homo sapiens; identical to SEQ ID NO: 26190

SEQ ID NO: 26192 - DNA, 63 bp, Homo sapiens
tagataacattgtaaagcgcttctttcgcggttgggctggagcaactctttacaatgtttcta

SEQ ID NO: 26193 - DNA, 59 bp, Homo sapiens
cctgggccagcggctgcggagggtgtactgggtcccccagcagtgctagcccaccggtg

SEQ ID NO: 26194 - DNA, 62 bp, Homo sapiens
cttggcattcccctgctaggatggaacagtgggtttgcaacctagcagaggaatgccaagct

SEQ ID NO: 26195 - DNA, 62 bp, Homo sapiens
aggccatgaccatcgagggccgccacctcatgagcaccgtggccatgatggtcctggccacg

SEQ ID NO: 26196 - DNA, 60 bp, Homo sapiens
acgcgggagcggggccagctcccaggaaagctggtctgcgagcggcccctgcccggctcc

SEQ ID NO: 26197 - DNA, 53 bp, Homo sapiens
gggcaggaggctgccggggcgccggaagctgctgtcccggcggagtcgcagcg

SEQ ID NO: 26198 - DNA, 76 bp, Homo sapiens
gccatagaagctgtggtggtcccagagcctgcactagagactgtggtgttctcggatcctgccgtagaggtggtgg

SEQ ID NO: 26199 - DNA, 60 bp, Homo sapiens
accgcgcctggccgggaaatatctcttacagaaataaaggcagttggctgggtgtggtgg

SEQ ID NO: 26200 - DNA, 50 bp, Homo sapiens
tgctctcgggaggcctggccctgaccgagacctgggcctgtgagtgcggg

SEQ ID NO: 26201 - DNA, 85 bp, Homo sapiens
gcggagtgagcgagggagacgggaggagccgaacccggcgccatccgccgccatcctcccccgccccaccgccatcccgtcccgg

SEQ ID NO: 26202 - DNA, 52 bp, Homo sapiens
gagccggggccatggcgaagctgctgagctgcgtcctaggcccccggctcta

SEQ ID NO: 26203 - DNA, 69 bp, Homo sapiens
gaaagaagagggcacatgggtgggaggcaaagggctaggctcacaccccgcctctgtaccccacctcct

SEQ ID NO: 26204 - DNA, 59 bp, Homo sapiens
ccctgggtctaggggagagagtccctgagtgtgagacccgccttccccggtcccagccc

SEQ ID NO: 26205 - DNA, 59 bp, Homo sapiens; identical to SEQ ID NO: 26204

SEQ ID NO: 26206 - DNA, 69 bp, Homo sapiens
ctttccagagcgaacctgtgcggctgcaggcaccggcgtgttgagtttccggcgttccgaaggactgag

SEQ ID NO: 26207 - DNA, 81 bp, Homo sapiens
cggggactcgttggcggcgtggaggggcgccggtggccacgttggtgtcaacctccttcgtgaagctcacacctcccccgc

SEQ ID NO: 26208 - DNA, 76 bp, Homo sapiens
gatgccgagtactggaacagccagaaggaagtcctggaggggacccgggcggagttggacacggtgtgcagacaca

SEQ ID NO: 26209 - DNA, 54 bp, Homo sapiens
gaggcaatctgtcaggcgccgcccgggcggcagtatgcctgagggggtcctccg

SEQ ID NO: 26210 - DNA, 55 bp, Homo sapiens
gaggggaggagggggagggctagtctgagccgcagccgccgcctcctccgctcgc

SEQ ID NO: 26211 - DNA, 55 bp, Homo sapiens
tagaacgagctggaggattctgcctaccgatacagagccttcgagtcgtccgggg

SEQ ID NO: 26212 - DNA, 67 bp, Homo sapiens
aggccagatggggcaggaaggctccgcaggaccggacccctagaccaccctgccccacctgcccctt

SEQ ID NO: 26213 - DNA, 69 bp, Homo sapiens
atgggagagagaagggctggttctggattgttgggaaactccacagtacttgaccttgactctccctca

SEQ ID NO: 26214 - DNA, 62 bp, Homo sapiens
gacgtccagactcaactctcggccggagccatagactcgagaattgcgtttggacaatcagg

SEQ ID NO: 26215 - DNA, 62 bp, Homo sapiens; identical to SEQ ID NO: 26214

SEQ ID NO: 26216 - DNA, 53 bp, Homo sapiens
gccgcagtcggccagccatggagcggagcttgctggcggcgaggccgcggcga

SEQ ID NO: 26217 - DNA, 52 bp, Homo sapiens
ggtccggggccggagaccgacggcaacagcggctcaggacccacgctgcccc

SEQ ID NO: 26218 - DNA, 53 bp, Homo sapiens
aggggaggggcggcgtgggccagggaggtctgacacacccccacctcccctag

SEQ ID NO: 26219 - DNA, 63 bp, Homo sapiens
cttcgcatggtattctgtgactggcaccttctgggacacaccacagaatgccatgtgaaggat

SEQ ID NO: 26220 - DNA, 63 bp, Homo sapiens; identical to SEQ ID NO: 26219

SEQ ID NO: 26221 - DNA, 60 bp, Homo sapiens
ggacggggtagggcggggcgcgcgcagttttccggcggcccctggcccgcccgcgtctgg

SEQ ID NO: 26222 - DNA, 56 bp, Homo sapiens
cggccgcggcgccccgggagccgaacgccctccttccaggtcccgccgcggtcgca

SEQ ID NO: 26223 - DNA, 64 bp, Homo sapiens
agacatcaaaggttcttgcttccaaagtgggaataaacggaaccatgaaccttttattgctcca

SEQ ID NO: 26224 - DNA, 58 bp, Homo sapiens
cttagaacttactcctgggcacagggtgtggtcacggcaaataggatgtgtctggact

SEQ ID NO: 26225 - DNA, 55 bp, Homo sapiens
ctcgccaccctcggcctgcggctcagccctcggcccgcaggatggatggcgggtc

SEQ ID NO: 26226 - DNA, 53 bp, Homo sapiens
acatcttttgggatgaaccggctcagtccttgagctcaccccaaagatgatga

SEQ ID NO: 26227 - DNA, 65 bp, Homo sapiens
caggtggcctgacacgggagggaaaaagaaattgtggtagtctctcccttcttcagtacacctac

SEQ ID NO: 26228 - DNA, 62 bp, Homo sapiens
tcagagggcagagggcccacgttggctttcctttctttacttggtcttctctgccctccagc

SEQ ID NO: 26229 - DNA, 62 bp, Homo sapiens; identical to SEQ ID NO: 26228

SEQ ID NO: 26230 - DNA, 54 bp, Homo sapiens
gaggggcaccaccagggctagcactgtaccgctaccgctggtggtggctctcga

SEQ ID NO: 26231 - DNA, 54 bp, Homo sapiens
aggacgcgcggcccggccctggccgtccctgagggcgcgggtggggcggggcgc

SEQ ID NO: 26232 - DNA, 59 bp, Homo sapiens
ccagggaggcccagggttggaccagagtctgggtccatcctccctgggcctctctggcc

SEQ ID NO: 26233 - DNA, 51 bp, Homo sapiens
cgcggggctggggcgcgccaggcggctgcggcgcgaacctgctcgcgcagc

SEQ ID NO: 26234 - DNA, 73 bp, Homo sapiens
gcgcctgaagggaggggccgagggggctcccggctcggcgggcagcgccgctcgggccacgcgctgggcgccc

SEQ ID NO: 26235 - DNA, 58 bp, Homo sapiens
ccacctgacctgattcaatgctttatccaaaccagcactgagtcaagtcaggtagtcc

SEQ ID NO: 26236 - DNA, 59 bp, Homo sapiens
ggtggttccttaaaacaaggcgctggttgaaccagcgccttgttttaaggaaccaccca

SEQ ID NO: 26237 - DNA, 62 bp, Homo sapiens
cgggggccgcccggggctgctcggcattggtgcggaaacccgagcccggagtcgctccctcg

SEQ ID NO: 26238 - DNA, 76 bp, Homo sapiens
gagagcaggtccggggtgcggcggggagagctcggggcaggcgagtcgccccggccccgttcccgctcccgctccg

SEQ ID NO: 26239 - DNA, 71 bp, Homo sapiens
cccggcgcccaccgcgggggccctctacagcggcagcgagggcgactcggagtcgggcgaggaggaggagc

SEQ ID NO: 26240 - DNA, 56 bp, Homo sapiens
aggctctctctgccagccgtgcggccaggcccgcggggtggtcggggggagccggg

SEQ ID NO: 26241 - DNA, 87 bp, Homo sapiens
ggctagcaccagcgctctgtcgggaggcgcagcggttaggtggaccggtcagcggactcaccggccagggcgctcggtgctggaatt

SEQ ID NO: 26242 - DNA, 57 bp, Homo sapiens
tgcagccatgtcttggcctcaagtggaacaagggctccttgaggccagcagggttgg

SEQ ID NO: 26243 - DNA, 68 bp, Homo sapiens
ggaggaggggcggggaggggagcaggttctggaagattcatgggctccttcctccgcccttcctcgag

SEQ ID NO: 26244 - DNA, 85 bp, Homo sapiens
accacgaagacccaggcagccgccctcgagccggggccagggcgtggccggcgcgggggcccagcgacgctgggatctccgctct

SEQ ID NO: 26245 - DNA, 79 bp, Homo sapiens
ctctacatcacagcccagcagttatcacgggcccctcccctcaatgggcccgtgataactgcagggctgtgatgtagag

SEQ ID NO: 26246 - DNA, 65 bp, Homo sapiens
cacagccctgcagttatcacgggcccattgaggggaggggcccgtgataactgctgggctgtgat

SEQ ID NO: 26247 - DNA, 58 bp, Homo sapiens
gggccgccgccggggagccggagcgggcaggaccctccctccgccgactgcggcccga

SEQ ID NO: 26248 - DNA, 79 bp, Homo sapiens
agaataagaaggatattttacttcataataggaattcattcctttttttaatgaattaagtgacatatttttcaatttt

SEQ ID NO: 26249 - DNA, 61 bp, Homo sapiens
ttcgagaccctgctggtccatggggtctcactatgtgggccagcatggtcttgaactccta

SEQ ID NO: 26250 - DNA, 50 bp, Homo sapiens
ggcggcggcggcggtggcggtggtagcgccgacgtgtcccgcctccttga

SEQ ID NO: 26251 - DNA, 66 bp, Homo sapiens
gaacacaatatgcagtggacactcaaatattgaatgagtgagtgcccactgcatattgtgttattg

SEQ ID NO: 26252 - DNA, 55 bp, Homo sapiens
tgtttaaccttttgcctattggttaaacttttcaatagacaaaaggttaaacaaa

SEQ ID NO: 26253 - DNA, 76 bp, Homo sapiens
ttgctcagacaccatccccagaaaacaatgatgtgttattacgctcttcttttctggggatggtgtttgagcaaat

SEQ ID NO: 26254 - DNA, 63 bp, Homo sapiens
gtgcgcggctcctgcgcacgagtggctccaaggggccagtacttcgcgggggtcagggcgcgt

SEQ ID NO: 26255 - DNA, 62 bp, Homo sapiens
gcatattactaatgaaagaagctaatctgaaaaggctacctactctatgatatatatatgac

SEQ ID NO: 26256 - DNA, 51 bp, Homo sapiens
cccgctccccgccgggaacaacctctccactcttcctgcagggagctggtg

SEQ ID NO: 26257 - DNA, 81 bp, Homo sapiens
ctggaggcctctgggcgcgtgcgcgggcggtcgctacctgcggccgagccagggagcgagagggcgcagagggcagcgggc

SEQ ID NO: 26258 - DNA, 54 bp, Homo sapiens
ggggaggtgcaggagcgagcggcgtcctcgtcctctcgtcccggccctgcccgc

SEQ ID NO: 26259 - DNA, 65 bp, Homo sapiens
gtatagaagctgggctttaaaataataatgagtgtaaccatggagttgggtattatcctatttga

SEQ ID NO: 26260 - DNA, 92 bp, Homo sapiens
ggaaccttagtaaggtttggatagatgcaataaagtatgtccacagctgaaaggacatactttattgcatgtatccaaaccttactaattca

SEQ ID NO: 26261 - DNA, 58 bp, Homo sapiens
tagcttatcagtgactgactcactaagcaagttcttctgtgcacagtcctgagctggg

SEQ ID NO: 26262 - DNA, 53 bp, Homo sapiens
tagcttgtcagactgatcaaaacatggcagtgttttgtggtcgtgggggaagt

SEQ ID NO: 26263 - DNA, 63 bp, Homo sapiens
ctgggctgtagtgtgctatgatctactatggttgcacctgtgaatagccactgcactcccacc

SEQ ID NO: 26264 - DNA, 53 bp, Homo sapiens
cggaggggcggggcgggggctgccagacgggcgcgccagccgcgccaagcatc

SEQ ID NO: 26265 - DNA, 60 bp, Homo sapiens
gtgcctgtgtgtgcgtgtgcgcgcacacacacgcgcgcgcacacacacacacagacacct

SEQ ID NO: 26266 - DNA, 57 bp, Homo sapiens
tcccggtcctggctgggggcgggcgaacgaggccccacctctgccgggagcgggacg

SEQ ID NO: 26267 - DNA, 53 bp, Homo sapiens
cccctcctccccgcgccccgccactcgccgggctgcggcggcggagtggtggc

SEQ ID NO: 26268 - DNA, 64 bp, Homo sapiens
tctgcagcctacctcatcagaccctggactcaccaagccagggtgatgggatgggctgttgact

SEQ ID NO: 26269 - DNA, 58 bp, Homo sapiens
gtgtccccacggcgggcagcagcggcggcggcggcggctgaacgcggagggggcggag

SEQ ID NO: 26270 - DNA, 63 bp, Homo sapiens
tgaccttgaccctccctgtgccaaggtccccgtcccctctgggtacagggagggtcaaggtca

SEQ ID NO: 26271 - DNA, 55 bp, Homo sapiens
cccccgcgggagcgcgcaggggtcacgtgagaggcccctgttttcggcgtgcggg

SEQ ID NO: 26272 - DNA, 73 bp, Homo sapiens
ccgtgccctgcgcccgcactcctcagcccttgggtggtcgatgggactgggcgctgtggagcagggggcggtg

SEQ ID NO: 26273 - DNA, 67 bp, Homo sapiens
acacacgcatgccttgtgcctaatgacaattttgtctttaggcacaaaacatgcgtgtgtcatctga

SEQ ID NO: 26274 - DNA, 67 bp, Homo sapiens; identical to SEQ ID NO: 26273

SEQ ID NO: 26275 - DNA, 57 bp, Homo sapiens
gggctcagatgttaactggatgaacagaaagctcatcgagttaacatccaggcccag

SEQ ID NO: 26276 - DNA, 66 bp, Homo sapiens
taagccactgtgcctggccacaaaccatattttagaaagtgcactggacaggcacagtggcttaca

SEQ ID NO: 26277 - DNA, 57 bp, Homo sapiens
gtgtgcgtgtgcgcggtgggagtcgggcaggcctttccgccgcgcacacacacagca

SEQ ID NO: 26278 - DNA, 60 bp, Homo sapiens
gctgtgtgtgtgcgcggcggaaaggcctgcccgactcccaccgcgcacacgcacactcac

SEQ ID NO: 26279 - DNA, 63 bp, Homo sapiens
gggcggatcgctgcctgcagggagtcggggatgccaggttccagctgagcagcggccgcccgc

SEQ ID NO: 26280 - DNA, 55 bp, Homo sapiens
ggtgcatgggctttgctgtgcattatgggtgcactgcatgggtggtatgcaccat

SEQ ID NO: 26281 - DNA, 87 bp, Homo sapiens
tcagggccgttacgcgattttcgctcccgcgggcagcgcctctcaggccactcccgagggaccccgaggacgcactcgggccccagg

SEQ ID NO: 26282 - DNA, 79 bp, Homo sapiens
tagctgtgagactgtagccaagttacccaacctccatttcctcttctataatgttggtacctgcctcaaagtcatcatc

SEQ ID NO: 26283 - DNA, 84 bp, Homo sapiens
ggtgcaagcctgtagtcccagatactcaggaggctgaggtgggaggatcgcttgagacaaggaggtctgggctgtagtgcgcta

SEQ ID NO: 26284 - DNA, 56 bp, Homo sapiens
ggccagcgcgccctgcatctcccccatgggcagcgggcggcggggcgcgcggcaga

SEQ ID NO: 26285 - DNA, 71 bp, Homo sapiens
ccccggactgcgctcacctgtctgggccgctggcctgggaggcgggggccggcgggagccaagccgaggaa

SEQ ID NO: 26286 - DNA, 55 bp, Homo sapiens
cacctcctcgagcagtgccacccgaggccggggcagctctgttggcgggggcagc

SEQ ID NO: 26287 - DNA, 55 bp, Homo sapiens; identical to SEQ ID NO: 26286

SEQ ID NO: 26288 - DNA, 66 bp, Homo sapiens
agtgtcttccaatttctctctgctctggaaatttggagggggtgggggggaagggtcgggcgccgt

SEQ ID NO: 26289 - DNA, 66 bp, Homo sapiens
gtgcaacagtaattgcaggttttatcattactttcaatggcaaaacacgcaattaactgttgcacc

SEQ ID NO: 26290 - DNA, 66 bp, Homo sapiens
tgactactttgtttgattttgttttctgaagacataaataaaacaaaatcaaacacggtagtcaca

SEQ ID NO: 26291 - DNA, 57 bp, Homo sapiens
tgtgtgtgtgcttgtatatatatatatatatatatatatatacaagcacacacacaa

SEQ ID NO: 26292 - DNA, 64 bp, Homo sapiens
gcggcggcgcggcggcgcggggcgggcggccagggctcccctctcccgctggcgctcccggcgc

SEQ ID NO: 26293 - DNA, 62 bp, Homo sapiens
cgcgtccagctgggaggagctttacgaccatgtggtaaagctcctccccagctgggtgctgt

SEQ ID NO: 26294 - DNA, 52 bp, Homo sapiens
cggcggcgcccagatgcggccgcggcggcgcggagctcgggcggccgtggag

SEQ ID NO: 26295 - DNA, 77 bp, Homo sapiens
gccagctccacctccccgagccacaggcccggctcctgcagggccagggccccgtcgcccgccgcggtgccggccgg

SEQ ID NO: 26296 - DNA, 72 bp, Homo sapiens
tcctcctagctctgtctttccagtagtgtgtcagtttataaatcaattggaagggcagaagccaggaggaag

SEQ ID NO: 26297 - DNA, 55 bp, Homo sapiens
tcccctcagtgtgccactaaatacaacttgtatttagtggcatactgaggggatt

SEQ ID NO: 26298 - DNA, 64 bp, Homo sapiens
cggcgacgccgcccagccgtcgtttttgatctgctgcagccgccggcggggcgacccagcccga

SEQ ID NO: 26299 - DNA, 86 bp, Homo sapiens
gcaactggcggtggccgacgagctccgcgccaagacaggggcccggcctggcgcgggcgccgaggagcagcggccaccgagagccc

SEQ ID NO: 26300 - DNA, 58 bp, Homo sapiens
ataaggccactgggtggtgagcggttcttttcacacttcacatccagaggcttttcct

SEQ ID NO: 26301 - DNA, 59 bp, Homo sapiens
tacacctctccaaatatacagttaactgatgttttactgtttatttggagaggtgtact

SEQ ID NO: 26302 - DNA, 52 bp, Homo sapiens
tgcggcgcgctcaggcgggcgggggacgcgtcggcctctgtggcgccgccct

SEQ ID NO: 26303 - DNA, 64 bp, Homo sapiens
cgccgcctggctccgggggatggttttgtcaagcggccagagccccggcgccaggcgcagccgc

SEQ ID NO: 26304 - DNA, 64 bp, Homo sapiens
ctcctccagatcacatgtgtgcaaattatggcttcagaggtggaagataaacagtgacggggga

SEQ ID NO: 26305 - DNA, 74 bp, Homo sapiens
ccgctcccgctcagggcgccgcggccacagctgagaccccagcgccgcgcagccgcccccgccggggcatgggc

SEQ ID NO: 26306 - DNA, 55 bp, Homo sapiens
cggcggcgggcgggggaggggctgggccgcggcgccttctcttctctgccccgct

SEQ ID NO: 26307 - DNA, 85 bp, Homo sapiens
ctcaaggagggtggaagcgccgccgcgctgtcctcctcctcctcctcctccgcggcggcagcggcggcatcctcttcctcctcgt

SEQ ID NO: 26308 - DNA, 51 bp, Homo sapiens
cggctgctgcgtgcccagggcgcccaagcccgggtgctcgtagcggccgcc

SEQ ID NO: 26309 - DNA, 69 bp, Homo sapiens
tcgggccgaaaggagcgagcggggcctgccggcagaggccgccgggctgctgtgtgactcggtcccctc

SEQ ID NO: 26310 - DNA, 63 bp, Homo sapiens
atagacatttatctccatgtggaggactgggatggtccctccacagggagataaatgtttatc

SEQ ID NO: 26311 - DNA, 63 bp, Homo sapiens
gatggcctctcctggcagcagagtgtttgcaaatcccctgaagccagaagcatgccagtcaga

SEQ ID NO: 26312 - DNA, 74 bp, Homo sapiens
ccagcggctgggcctgagcgtcgagactcggggccgaggcggaggagcggccgccgcgccggggcccagccgga

SEQ ID NO: 26313 - DNA, 60 bp, Homo sapiens
acaacatagccaggcctcgtctttttttttttcttgagacggagtctcgctctgttgccc

SEQ ID NO: 26314 - DNA, 63 bp, Homo sapiens
ccagccccaacctaagcatgtgactgtactcaccttgtcagatgctgttggaacctggctgac

SEQ ID NO: 26315 - DNA, 73 bp, Homo sapiens
cgccagcatctaatgggactgctgggaggattgagtcccatatctgaagtcccttgagataccggcatccctg

SEQ ID NO: 26316 - DNA, 73 bp, Homo sapiens; identical to SEQ ID NO: 26315

SEQ ID NO: 26317 - DNA, 53 bp, Homo sapiens
ggaaggagcgggggggaggggctgccaagctgctgcacccccaaatccctcag

SEQ ID NO: 26318 - DNA, 64 bp, Homo sapiens
aggtcagggaacgcgggagccgcagggttccagggatcccgcggctcctcgcggcttggcctga

SEQ ID NO: 26319 - DNA, 51 bp, Homo sapiens
gtggtgtgttacccagtagctcctgggacatcgctcgggtacgctccacgc

SEQ ID NO: 26320 - DNA, 68 bp, Homo sapiens
tggggggagcccttagcacactcagaagtgacctctgggaaggagtgcgatgaggggagtcctgagca

SEQ ID NO: 26321 - DNA, 106 bp, Homo sapiens
ctggcttccaaaggcctctgtgtgttcctgtatgtgggcgtgcacgtacctgtcacatgtgtacgcgcagaccacaggatgtccacactggcttccaaacacatct

SEQ ID NO: 26322 - DNA, 75 bp, Homo sapiens
cgatgggatgcggccgtgggcggtggagtccaggcggagtccgctctccacacgcgagggcgcctcctcctcacc

SEQ ID NO: 26323 - DNA, 58 bp, Homo sapiens
ggagggggatgagccagggctgagccgtggcatcaggctgggctcctctccccaccct

SEQ ID NO: 26324 - DNA, 51 bp, Homo sapiens
ctcgccggggctgaaccggctgagcttcccagggacgccccgacccaagcc

SEQ ID NO: 26325 - DNA, 63 bp, Homo sapiens
gcgccccgcggcccgccagcgccgccgccaccgccatggccgtcgccagcgcgccgcccgcgc

SEQ ID NO: 26326 - DNA, 68 bp, Homo sapiens
ccagatcctctgcgcgcacccgcggagacccgacccggccgagggcagagcgcaggggaacccgggca

SEQ ID NO: 26327 - DNA, 68 bp, Homo sapiens; identical to SEQ ID NO: 26326

SEQ ID NO: 26328 - DNA, 87 bp, Homo sapiens
gggagggcgcgctcggttctggccaggccagcagctgcggccgagtggggggctccggcctggccgcttcctgggaccccctcccgc

SEQ ID NO: 26329 - DNA, 54 bp, Homo sapiens
agctatgccacctgcacccaggggagtctctgaggacagggcagcctcgactgg

SEQ ID NO: 26330 - DNA, 52 bp, Homo sapiens
ccggccacgcgcctctgtcttggggatggcatctaggcggtggtaggtggcc

SEQ ID NO: 26331 - DNA, 86 bp, Homo sapiens
cgtgcgccccgggccccgcgccggcactcgctcagcgaccgcggcggagacacgagcggcggcggcggagcccagagggcggcggg

SEQ ID NO: 26332 - DNA, 53 bp, Homo sapiens
gccgtccgtgcccgcgggacctgacagccgggtcagaggtcagtgcgcggggc

SEQ ID NO: 26333 - DNA, 52 bp, Homo sapiens
gtcccagcgtctgtcccgccggccgggcggtcgcggcacagccgcgggaagg

SEQ ID NO: 26334 - DNA, 74 bp, Homo sapiens
gggcctcttgctgcctgggcctgtgttcactcccgcccaggaggcagcagaggttaagctaagcagaggcatcc

SEQ ID NO: 26335 - DNA, 79 bp, Homo sapiens
tagctccaaaggacagggcgttaggatgggaggtggcccagggaccccgcctcccccagggccaggtctgggggctcct

SEQ ID NO: 26336 - DNA, 52 bp, Homo sapiens
taggtgattctgagcctggcctgtattgagagccactgatgagcctctgagg

SEQ ID NO: 26337 - DNA, 89 bp, Homo sapiens
ccggcccctcgggccgcttccctccctcgggcccgaggccgccgcggaggcggtgtccgtgcacccgagcgcggcctggaggagcggcg

SEQ ID NO: 26338 - DNA, 56 bp, Homo sapiens
ggagagggcctggggcccggctggctgcaccccgcactccgggccccggcccccgg

SEQ ID NO: 26339 - DNA, 61 bp, Homo sapiens
atcaggcccaccgggtcgcctccaaatcagatctccaagggggaccctgggggcctgagtc

SEQ ID NO: 26340 - DNA, 60 bp, Homo sapiens
tcggctgtggggtcctgtggtgtgtggggagctgtcacatccagggtcctcactgcctgt

SEQ ID NO: 26341 - DNA, 60 bp, Homo sapiens; identical to SEQ ID NO: 26340

SEQ ID NO: 26342 - DNA, 74 bp, Homo sapiens
gccccccgggccgtcttcccctccatcgtggggcgccccaggcaccaggtaggggagctggctgggtggggcag

SEQ ID NO: 26343 - DNA, 53 bp, Homo sapiens
cgcggcgggcgtaggactttgggctttcgcctcgtcctgcgcttgaccccaga

SEQ ID NO: 26344 - DNA, 80 bp, Homo sapiens
cggatgtgagtggagcggccatttcctgtttctctgcagttttcctcagctttgggtggtggccgctgccgggcatcggc

SEQ ID NO: 26345 - DNA, 82 bp, Homo sapiens
gggtgtacaccccctgcgacattggaagtagtatcatctctcccttggatgctacgaacaatatcacagaaggtgtacaccc

SEQ ID NO: 26346 - DNA, 59 bp, Homo sapiens
tccgggccgttgccctgtcagcacgatgcctggagcggtggcggcggcggctccgggct

SEQ ID NO: 26347 - DNA, 70 bp, Homo sapiens
ggcggcgggggtgtgcgttggggagggggagccccgagactcctcccccacagcgatacccccgcccctc

SEQ ID NO: 26348 - DNA, 58 bp, Homo sapiens
ttatctcacttaatactcaacttgactaggtaattttgagtatttaatgagataatgt

SEQ ID NO: 26349 - DNA, 55 bp, Homo sapiens
gctggcgcgctctggggtgcacacggctaggatgcgagagaggcgaggccggcga

SEQ ID NO: 26350 - DNA, 60 bp, Homo sapiens
ctgaagtaattgcggtttttgacattactttcaatggccaaaaccgcaattactttagca

SEQ ID NO: 26351 - DNA, 66 bp, Homo sapiens
tcggcgccgcggggaagcctccgttagggcccctcgggggtgggggcgtcctcgtggcgcttgggc

SEQ ID NO: 26352 - DNA, 74 bp, Homo sapiens
gagcgtttctaagggggccgcccggccttgtctttcggcagtggccgagccaccgccgcctgccgcgcgttcca

SEQ ID NO: 26353 - DNA, 54 bp, Homo sapiens
gctatggggccgggcggccgtgtggcgcggctgctcgccccactaatgtggcgc

SEQ ID NO: 26354 - DNA, 52 bp, Homo sapiens
agctggtccgcagggaagcctttggcttccccaccggcaatggagcggttga

SEQ ID NO: 26355 - DNA, 59 bp, Homo sapiens
cgcacgaggtactgggagtgagcaccctcttcactggggcactccaagtacctcactcc

SEQ ID NO: 26356 - DNA, 53 bp, Homo sapiens
ttattcacagtacagtgccccacatagagtagcactgtgccattgaagaagaa

SEQ ID NO: 26357 - DNA, 73 bp, Homo sapiens
cccgcggagaacccaggggcggcccgcgcgcgtcggcctagcggggagggctgctccgggacacggtgcggcg

SEQ ID NO: 26358 - DNA, 64 bp, Homo sapiens
atgcgtgcacatacatgtatacacgtatgcatacatacgtgcacatacatgtaggcacgcatac

SEQ ID NO: 26359 - DNA, 65 bp, Homo sapiens
cccggccccggaggagcccgcgcaggccgagccgagcgccgcgctgcccgcccgggaggagggcg

SEQ ID NO: 26360 - DNA, 66 bp, Homo sapiens
atccaaaatgactgcttggggagactgactctaagccactgtctacccagcagtcattttggatct

SEQ ID NO: 26361 - DNA, 54 bp, Homo sapiens
caaatataaaagacaacatattatttaacataatatgttgtcttttatattttt

SEQ ID NO: 26362 - DNA, 54 bp, Homo sapiens
atcatgccactgaggatttggtgatggggcctatgtttttaaacctcttgtggc

SEQ ID NO: 26363 - DNA, 58 bp, Homo sapiens
aacctgggatcttgccacttccctctcatttgaatgatgtggttttgaaatcagtgct

SEQ ID NO: 26364 - DNA, 58 bp, Homo sapiens
ggtggaggcggcggcggcggctgcagccgcagctccagtcaccgcgtcgcctccccgc

SEQ ID NO: 26365 - DNA, 63 bp, Homo sapiens
tacctctctgggttctgtttcttccctgtaaaatactttagcaacagaacccagagagtcagc

SEQ ID NO: 26366 - DNA, 63 bp, Homo sapiens
tgaggcaggatgtcactgtcacccaggctggagtggagtatagtatggtgtcatcacggctca

SEQ ID NO: 26367 - DNA, 67 bp, Homo sapiens
gagcgatgcccgctcgggccgcccggggagggactggggccacccgggcggcggcgggggtgtgtcc

SEQ ID NO: 26368 - DNA, 74 bp, Homo sapiens
actcccggcctagggcctcgcgcactctgcggcccgcggggctgggcagcggggcggggcgaggcgggggcgac

SEQ ID NO: 26369 - DNA, 54 bp, Homo sapiens
cagagaacaggcacatctgtccactggaaaggtcagccgtgtctgttctctggc

SEQ ID NO: 26370 - DNA, 50 bp, Homo sapiens
cgggtcctagcgagctgtccggccagctggtctagcatgcaggtcccgcg

SEQ ID NO: 26371 - DNA, 67 bp, Homo sapiens
tgcccgtccctcgccatagagcaggccctggaagtggaaggggcatggtcagcgggggacggattgc

SEQ ID NO: 26372 - DNA, 50 bp, Homo sapiens
ggctcgcgggtcggggccgcgcggggccgtgcgcttgggcccggagccca

SEQ ID NO: 26373 - DNA, 62 bp, Homo sapiens
atgcactgggcaagatctcaatacagctttagaaatcctgtaagattttgaccagtggggag

SEQ ID NO: 26374 - DNA, 73 bp, Homo sapiens
tggggccagggccgcaggtggctgggcgggcaggagacgcagcctgatcgcgacctgcgcccccagccccctc

SEQ ID NO: 26375 - DNA, 75 bp, Homo sapiens
agggggctgggggcgcaggtcgcgatcaggctgcgtctcctgcccgcccagccacctgcggccctggccccaccc

SEQ ID NO: 26376 - DNA, 71 bp, Homo sapiens
tgggaggggcagtgggtgccgggccagcagcaggccaggaggtaaccattccccacctgtccctgcccagc

SEQ ID NO: 26377 - DNA, 59 bp, Homo sapiens
gccgggtggggtgggggcggggagggagccccccctacgccctccgcagtgcctggcga

SEQ ID NO: 26378 - DNA, 84 bp, Homo sapiens
ggcagcaggtaggcgcgcaggcggctgacggcactagcgttgacgcagagcccgcggccgtccagcagcgcctgcagcggtcgc

SEQ ID NO: 26379 - DNA, 76 bp, Homo sapiens
agcagatggttgtagctcaccagtatagcttcgccccagatggggaggcccggctggtgagccgctgccctgcaga

SEQ ID NO: 26380 - DNA, 53 bp, Homo sapiens
tcctcccgccgccgccgcccggaccgctcggcggccgccagcgcgggaggagc

SEQ ID NO: 26381 - DNA, 76 bp, Homo sapiens
ccgcctcggtgtatctggagatccaatggtggttcctgcgggggccggaggacctggatcccggggccgagggggc

SEQ ID NO: 26382 - DNA, 66 bp, Homo sapiens
cgcagcgcggccgcagcagcctccgccccccgcacggtgtgagcgcccgacgcggccgaggcggcc

SEQ ID NO: 26383 - DNA, 60 bp, Homo sapiens
ttagctcgtgtggtgattgctgcacacgggatatgtgcagcaagtatctgctgagctaat

SEQ ID NO: 26384 - DNA, 89 bp, Homo sapiens
gagcggggcgtctgagcgtgcactgcctcgtcgcgggctgctcgcacatcaggcggccgcagaggcggtgggcgctgtgcctctgccct

SEQ ID NO: 26385 - DNA, 58 bp, Homo sapiens
agtgaggcagcagggtttccagggggagcctgccccagtgccctctgagctcactgag

SEQ ID NO: 26386 - DNA, 85 bp, Homo sapiens
aggcgcgcagggctgtggctccccgtcgctccaccgtctgcgctcccaggcaaggtcctctggggcgcctcggaactgcgcgccc

SEQ ID NO: 26387 - DNA, 58 bp, Homo sapiens
tatatatatgagtatatatatatatgagtgtatatatatatatatgagcgtatatata

SEQ ID NO: 26388 - DNA, 77 bp, Homo sapiens
gcgggcggcgggcggcggcggcggcgggcggcgggcggcggcggcggcggcggcggcgggcggcggcggcggcggga

SEQ ID NO: 26389 - DNA, 62 bp, Homo sapiens
aattaggcccaacagttcccgtagggctaaagtctcttatgggagacagttgagcctagaga

SEQ ID NO: 26390 - DNA, 69 bp, Homo sapiens
cacccagctggagcggacatgacgtcttccgggaggcggcggggtctttgtctcgctgcagcgggtgct

SEQ ID NO: 26391 - DNA, 61 bp, Homo sapiens
tcccagaattcactatatgtaggatggatatggattcactatatatagtggattctgggat

SEQ ID NO: 26392 - DNA, 55 bp, Homo sapiens
gaagcatggcccgggggtcggcggttgcctgggcggcgctcgggccgttgttgtg

SEQ ID NO: 26393 - DNA, 51 bp, Homo sapiens
ggcgcgagcgggtcggcgttgagggagccaccgccctcccgcctgcgcact

SEQ ID NO: 26394 - DNA, 73 bp, Homo sapiens
aggctccgtgtccagacgccagctgcctgctcagccccatggctagctgcagctggcatggacccagggctcg

SEQ ID NO: 26395 - DNA, 73 bp, Homo sapiens
acgcgcaacagctggagggcgacgctggctccgcggcgactcctggggctgcggccgcggtggtagcgcgaat

SEQ ID NO: 26396 - DNA, 89 bp, Homo sapiens
ggccatcagctgtcaagatggggggttcagctccctaaagcggggcagcctcagagggagccgagcctgcccaggatgagcggcgccgg

SEQ ID NO: 26397 - DNA, 54 bp, Homo sapiens
tagctttagtcactgccagcagctatttctaggctgttggcactttgaagtgga

SEQ ID NO: 26398 - DNA, 90 bp, Homo sapiens
caggtctccaaggtggagtcagaaagagaggaatggtggccgggcacggtggctcaagcctgtaatcccagcactttgggaggccgtggt

SEQ ID NO: 26399 - DNA, 58 bp, Homo sapiens
gagagtaattgcggtttttgccattactttcaaaatggcaaacaccaattactctcgt

SEQ ID NO: 26400 - DNA, 62 bp, Homo sapiens
atggcctttgagaggtgattgggtcatgatatagtgacccaatcacctctcaaaggccctat

SEQ ID NO: 26401 - DNA, 75 bp, Homo sapiens
atgtgagcccctgtgcccagcccagcaggaactttaaaagagctgcacctgggccaggcgtggtggctcacacct

SEQ ID NO: 26402 - DNA, 53 bp, Homo sapiens
cccggactggagctgcctggcgtcggtgcccgcgcccggcccagcccggggcc

SEQ ID NO: 26403 - DNA, 76 bp, Homo sapiens
cgcgggacagctggcccgtatcctcacactgggcccggggcccagccggaggggcgggggcctggccactcgggcc

SEQ ID NO: 26404 - DNA, 61 bp, Homo sapiens
aggcaggggaggctctccaggctttggggccgtgacagcagcttgggtctctcctgcttcc

SEQ ID NO: 26405 - DNA, 60 bp, Homo sapiens
gcaagaaagtgagactctgcctcttttttgtttctgagccagagtcttgctctgttgctc

SEQ ID NO: 26406 - DNA, 58 bp, Homo sapiens
cggcgtttgagtggcaagttgtttgttacagcgaacaccagctgctccccgcgccggg

SEQ ID NO: 26407 - DNA, 62 bp, Homo sapiens
tggcctgcagtggacgagcatcgcatagcctgcggggctggatgctgaccgcccgggccagc

SEQ ID NO: 26408 - DNA, 59 bp, Homo sapiens
gttccgggggtggcggagtcgcctggagacggcggctgcggcttctacagctcggaccc

SEQ ID NO: 26409 - DNA, 50 bp, Homo sapiens
ggcggtggcggaggagcctcgggtgggccggggttgctgcgccgtcctcc

SEQ ID NO: 26410 - DNA, 68 bp, Homo sapiens
ccgcgggccggcagcgagccaggcgcctcaggccccacggcgacctggcccgggctctgcccccagac

SEQ ID NO: 26411 - DNA, 80 bp, Homo sapiens
ccctggcctgagaagctccggcaccagctcctcccggccggcggcccgcacctgagccggagccggagccgggcacggcg

SEQ ID NO: 26412 - DNA, 54 bp, Homo sapiens
aaaagtaattgtgatttttgtcattaaaatcgcaaaaaccgtaattacttgtgt

SEQ ID NO: 26413 - DNA, 54 bp, Homo sapiens
cctgctgccgacagctgctgctctgacagaggcggcggcggcgacagcacagag

SEQ ID NO: 26414 - DNA, 53 bp, Homo sapiens
tggggaggcggcaagaggacctgcggcaggccctcttcggcagtctctccggc

SEQ ID NO: 26415 - DNA, 75 bp, Homo sapiens
agtcctatggaaaatggagtcaacaatactgattgcaactgtaaaaattgttgactccattttccataggactta

SEQ ID NO: 26416 - DNA, 57 bp, Homo sapiens
ccgggtgtgcacctcagctgcggcctgcgcggtgctcagctgcggcgcattccctcc

SEQ ID NO: 26417 - DNA, 79 bp, Homo sapiens
caggcatgagccacggcaatcaacctcattctattgtcttaaaatcgcagctgggtgggtgcagtggttcatgcctata

SEQ ID NO: 26418 - DNA, 72 bp, Homo sapiens
gtcagctcccctttctcgcccagcgcccccaggccgctcccggggctcacggtgagacttggggccggcctc

SEQ ID NO: 26419 - DNA, 63 bp, Homo sapiens
gctgtcctgtgagggagaccagacccttttgaacgccactgggctccccagcatgacagatgg

SEQ ID NO: 26420 - DNA, 67 bp, Homo sapiens
caggacctgctcccacgagggggcggggccaagatggcgccgagcgccgggtgagcagcgtctcggc

SEQ ID NO: 26421 - DNA, 53 bp, Homo sapiens
gccggggagggggcgggacagagctgggtccccctgctcctcctcgaccccgc

SEQ ID NO: 26422 - DNA, 72 bp, Homo sapiens
gggccatgtagttcttgcttcgccactcaagactggtcggaagcggcatagacaccggggacagcaccacca

SEQ ID NO: 26423 - DNA, 71 bp, Homo sapiens
cagcggcggcaggtgagcgggggaggctggcccccggcccgcgacggcctcgcgcccacctggtcactgcc

SEQ ID NO: 26424 - DNA, 70 bp, Homo sapiens
ccctcggtctagtctggccaccttcccagtctggtgggtgcaggtggggagaagcctgggtctgggggca

SEQ ID NO: 26425 - DNA, 60 bp, Homo sapiens
ggcgtggcccaaccgggaactggggcgtcgaactccccttcccagtctggagccacccat

SEQ ID NO: 26426 - DNA, 62 bp, Homo sapiens
cggggcgcggcgtggggtgggcgcgtgcgcacacgctcgctctaaccgccgcgcgccccgca

SEQ ID NO: 26427 - DNA, 53 bp, Homo sapiens
cttcccggggctacgctcattcttactgtccaagtgaggccaggggactggtc

SEQ ID NO: 26428 - DNA, 59 bp, Homo sapiens
ggccgtgagcgcagaggccatggagccggagctcgcggacacctctgcactcaaggcgg

SEQ ID NO: 26429 - DNA, 85 bp, Homo sapiens
tctgaggtacccggggcagattggtgtagggtgcaaagcctgcccgccccctaagccttctgcccccaactccagcctgtcagga

SEQ ID NO: 26430 - DNA, 63 bp, Homo sapiens
tggtggcggcggtagttatgggcttctctttctcaccagcagcccctgggccgccgcctccct

SEQ ID NO: 26431 - DNA, 58 bp, Homo sapiens
acgcgcgccgggagccgcgggccgggccagccgggccgccggggcccagtgcgccgcg

SEQ ID NO: 26432 - DNA, 84 bp, Homo sapiens
ctgagtccacaatgcctggctttcactggcacctgggaccatgggggtgggcctggagtctgtgagtcaggcctggtcttgggt

SEQ ID NO: 26433 - DNA, 66 bp, Homo sapiens
gccgggaggcggaagtccaagcaggttgtcccaattttggcctgcaaagacttccttctctcgcct

SEQ ID NO: 26434 - DNA, 71 bp, Homo sapiens
tctgttgtacctcccgattaatttaggtttgacttccttcttcagcatcttcggcaatgtagtaatagaat

SEQ ID NO: 26435 - DNA, 84 bp, Homo sapiens
tttttttcgggctccactccctgcttgtgtccccccaactctgttgcctgtccttcccgcagccctgtgcagagcccgagtgcg

SEQ ID NO: 26436 - DNA, 70 bp, Homo sapiens
ctctgctgtaagtgagctgctccctgtaggcaagctacataacctatctgggactcattttcaggaaggt

SEQ ID NO: 26437 - DNA, 51 bp, Homo sapiens
cgggtggggagcccgagccagcccaggccggctctggcctcctgacccaga

SEQ ID NO: 26438 - DNA, 109 bp, Homo sapiens
tgctattgtcttactgctacagcagggctggggattgcagtatccgctgttgctgctgctcccagtcctgcccctgctgctacctagtccagcctcaccgcatcccaga

SEQ ID NO: 26439 - DNA, 56 bp, Homo sapiens
cgcgcggtgcaggcagctgcgtgggatttgcgcgccccctccccgccccgcgccct

SEQ ID NO: 26440 - DNA, 66 bp, Homo sapiens
gcagaatctcagccctacccaagacatgcaaaataagatgtcttgggtaaggttgagattctgcat

SEQ ID NO: 26441 - DNA, 76 bp, Homo sapiens
gggcgcgcgcagcggctggagcgcgggggcgaggccgggccacctccccttcccggccgcgcactgcctggcccgc

SEQ ID NO: 26442 - DNA, 97 bp, Homo sapiens
tattatgccatgacattgtgtcaatatgcgatgatgtgttgtgatggcacagcgtcatcacgtggtgacgcaacatcatgacgtaagacgtcacaac

SEQ ID NO: 26443 - DNA, 78 bp, Homo sapiens
cccgccctccggcccgcacccggggccccctggctctgaagagcggggctcaggggcccggcggcccgcggcggggct

SEQ ID NO: 26444 - DNA, 68 bp, Homo sapiens
ggcgtcctgcgactgcccgaggtcggaggcccggaggacccgccgccgcctttgtgtcaccagccccc

SEQ ID NO: 26445 - DNA, 90 bp, Homo sapiens
ctctcggctcgccccctcggcccttcccggctctcgtacgcgggcgggcgggcgggcggcgcggtggggccgggctggggcgcgggagcc

SEQ ID NO: 26446 - DNA, 62 bp, Homo sapiens
ccggtaggaggaaggaggaaggagaggccgtttttgaccttcctccctctccctgcctggtc

SEQ ID NO: 26447 - DNA, 52 bp, Homo sapiens
cacctcctctgcggcagctgcgcctcgcaagcgcagtgccgcagcgcacgcc

SEQ ID NO: 26448 - DNA, 61 bp, Homo sapiens
gggcggccggggagggcggcggcccctttaagagcaggccacgccccctcccctcctcccg

SEQ ID NO: 26449 - DNA, 78 bp, Homo sapiens
aaaacttcatgaagcagtcatcacagaggatatcagtaattatggcaggagagcctctagtgttgctcagaatcaacg

SEQ ID NO: 26450 - DNA, 66 bp, Homo sapiens
gggcagaagggtgggtctcaagtgggaggataaggcttcaccaccaggagattcccctctgcccga

SEQ ID NO: 26451 - DNA, 64 bp, Homo sapiens
ccggcgcccgggacacttccggctcccggcagctgcctcagtcggaggtccgcgggcgccccat

SEQ ID NO: 26452 - DNA, 66 bp, Homo sapiens
cgcctctgccgcgccgagccccgcgcacgctgccccggccgccccgcaggcaggcaggcaggcagg

SEQ ID NO: 26453 - DNA, 59 bp, Homo sapiens
aattacagattgtctcagagaaaacaaatgagttactctctcggacaagctgtaggtcc

SEQ ID NO: 26454 - DNA, 59 bp, Homo sapiens; identical to SEQ ID NO: 26453

SEQ ID NO: 26455 - DNA, 52 bp, Homo sapiens
gaccgcggcgctggcaggccggggctgagcccggctccccgcgctggagcct

SEQ ID NO: 26456 - DNA, 69 bp, Homo sapiens
aggccctcactctcagggttgtacaagagcaggggtggcacttgtacagccctgagagtgaggacctcc

SEQ ID NO: 26457 - DNA, 69 bp, Homo sapiens; identical to SEQ ID NO: 26456

SEQ ID NO: 26458 - DNA, 60 bp, Homo sapiens
cggcgactccggccggagccccgggcgcggcggggcggggcggggcggcggcggcccggg

SEQ ID NO: 26459 - DNA, 78 bp, Homo sapiens
cctcctgcagcagccgcggcggcggcggcgcctcagtgcgcgcgcgcgaggccgcggcggctggcggagggggaggag

SEQ ID NO: 26460 - DNA, 58 bp, Homo sapiens
tcggctgtgtatctctgtgccagaagcttagccacagtgtggcacagtcgtgtccttc

SEQ ID NO: 26461 - DNA, 58 bp, Homo sapiens; identical to SEQ ID NO: 26460

SEQ ID NO: 26462 - DNA, 51 bp, Homo sapiens
aggctgctccggaccgggacgcagagtctgcggacccggcgccgaggcggc

SEQ ID NO: 26463 - DNA, 68 bp, Homo sapiens
tctgggcaggggagggctgcgggggtggagcctccggactcatgcccccacccttccttgcccacagg

SEQ ID NO: 26464 - DNA, 72 bp, Homo sapiens
cccaggatgcagtgtggaccggccgggcgctgacggaggcggcgcgactgcgggcggcgcggcgcaggggca

SEQ ID NO: 26465 - DNA, 66 bp, Homo sapiens
ccttgcccatagcgtgtgccggggccggcagtggcactgcacaggccagcggcgcagtgggcggtg

SEQ ID NO: 26466 - DNA, 65 bp, Homo sapiens
cgtgggataggtgggggccccctgcctgagccgacccctcaggtggccgttctctttcccacagt

SEQ ID NO: 26467 - DNA, 75 bp, Homo sapiens
tcgacggcatctccaccgggccggggggcggtcaccgcggggcggcccctgggccggggccccagagccttggct

SEQ ID NO: 26468 - DNA, 55 bp, Homo sapiens
ccgccggccgcggggaggagaccttgggaggtcgggccccagatggccggcggcg

SEQ ID NO: 26469 - DNA, 61 bp, Homo sapiens
agctcagggtgggccccatggttatggtttaaagagacagaaacatttcccattgagctgt

SEQ ID NO: 26470 - DNA, 60 bp, Homo sapiens
acacagagaaccgggccttgcgcgagctggtggccgagtgcgggggccgggtctgtgcct

SEQ ID NO: 26471 - DNA, 83 bp, Homo sapiens
cgggcccgcggaggagcggcgtgcgctggtgggtcccggctctccgccccgcagcgcgcccggccagctcccatcgccccggg

SEQ ID NO: 26472 - DNA, 62 bp, Homo sapiens
gccctgcggcggcggccacggcccagcccctcggaaagccctggcctagccgcaggcccctc

SEQ ID NO: 26473 - DNA, 62 bp, Homo sapiens
ggcaggatggcaggggagggacactgtgcctgccacagccaagtccccctcctccctgcaga

SEQ ID NO: 26474 - DNA, 77 bp, Homo sapiens
agcccgcgttccaccctctgtgccgccgccgcctcctgtgggagagggaggtggtcgggagagtgcacgccggtgcc

SEQ ID NO: 26475 - DNA, 66 bp, Homo sapiens
gcgagttggagaggtctgtggtgcgggtcgccccgggggatccccggcgcgggcctcgcgcgacgg

SEQ ID NO: 26476 - DNA, 52 bp, Homo sapiens
gcctggtctagcatgctataatacaaatgtatgttttagaagctatattgaa

SEQ ID NO: 26477 - DNA, 71 bp, Homo sapiens
ctccccggaggtaggcgggcgcgggccctgttgggtctttgggacgcgggtcccgctggggccggggatgc

SEQ ID NO: 26478 - DNA, 79 bp, Homo sapiens
cccacccctgctccccgcgccccttcgtttcggcctttgtctacaggccgggtcggaacgtcagccccaggagccgacg

SEQ ID NO: 26479 - DNA, 82 bp, Homo sapiens
cggcctgtaaatagcggggctggttgctgtggagacagtggcctcacttctcacaagcctggcttgtagatagcaggctggc

SEQ ID NO: 26480 - DNA, 58 bp, Homo sapiens
gtgtccccggcggcgggggcgcggagatgggggcgcccgcgcaggggccggggcgcat

SEQ ID NO: 26481 - DNA, 55 bp, Homo sapiens
tgtgcaaatctatatggaactgataacagcttatcttcaatcacatacagaaact

SEQ ID NO: 26482 - DNA, 83 bp, Homo sapiens
gagagggaatcaggttagagacatcaagaactgttatggcacatgtcacaattcttgatatctctcacctgattccctctcta

SEQ ID NO: 26483 - DNA, 63 bp, Homo sapiens
gcgcccggccggatgcacgtcggcggagcggcgcttgagctcggatgccccgggccgccgcct

SEQ ID NO: 26484 - DNA, 58 bp, Homo sapiens
cgcgcgggtcggcgcggtgccggaggttggcggcggcgacgacgctgggatgcgcggg

SEQ ID NO: 26485 - DNA, 57 bp, Homo sapiens
cctcactgggtctgggtttgagagtcttcctgggcctctggaccccccagtgtggcc

SEQ ID NO: 26486 - DNA, 69 bp, Homo sapiens
tgcccctccgtccgcgcgcgtccagagtgccgggcgtggaggcgtgggggcgtgggggcgtggggtggg

SEQ ID NO: 26487 - DNA, 53 bp, Homo sapiens
cgcgtcccgcaggagccgcaggcagagcgtccggcggccgggagggacgcgga

SEQ ID NO: 26488 - DNA, 61 bp, Homo sapiens
aggctctggtgctttctgtctctgtctcgctcctccaagactgaggtccacagagccagct

SEQ ID NO: 26489 - DNA, 61 bp, Homo sapiens; identical to SEQ ID NO: 26488

SEQ ID NO: 26490 - DNA, 57 bp, Homo sapiens
gccagcagcctggctcccaggacaggaggcctgccctgggggaggggctgcaggagg

SEQ ID NO: 26491 - DNA, 55 bp, Homo sapiens
cgggcgccgcgtccccggaggagctcgcgtcccctgaggagcgcgcgtgcccgga

SEQ ID NO: 26492 - DNA, 50 bp, Homo sapiens
tggcttgaggaccccgcgtcccccgaggagcccggggagcccgcgcccgt

SEQ ID NO: 26493 - DNA, 55 bp, Homo sapiens
acgagggctccatttctgtaagtgtcactctctcacggatatggaacccacgata

SEQ ID NO: 26494 - DNA, 60 bp, Homo sapiens
tagtctcagctacgaggctgaggcgggagaatcgcttgagccctggaggtagagactgca

SEQ ID NO: 26495 - DNA, 66 bp, Homo sapiens
cgctgccgccgggcaaaggcgcgcatgcgcagcgtcgccgcccgcgccttccgtgtggccagtgct

SEQ ID NO: 26496 - DNA, 72 bp, Homo sapiens
tggccagaaagcagctaaacaatagataaacactcattaatgtatctattgtttggctgctttctggccaca

SEQ ID NO: 26497 - DNA, 58 bp, Homo sapiens
gtgggtgagctaaatgggtgtccatcttttttcgggggcccatacagcagaaagcact

SEQ ID NO: 26498 - DNA, 60 bp, Homo sapiens
ggggcaaggggcgcggcgagcagggccgacgcctgggtgttcccgtccccctttcctcga

SEQ ID NO: 26499 - DNA, 55 bp, Homo sapiens
acggtgttgggagccctttggagaacgccagtctcccaggccccctgcatctatc

SEQ ID NO: 26500 - DNA, 63 bp, Homo sapiens
ggagctggccaaaaagcaggcagagacgcttttaaagtctctgcctgctttttggccagctcc

SEQ ID NO: 26501 - DNA, 75 bp, Homo sapiens
gccccgccctcggggcttcccgggcgcgcgcagccccgccgtgtccgcgcgccacgcccccctgctcgcgggccg

SEQ ID NO: 26502 - DNA, 67 bp, Homo sapiens
ggagcgctgggcggccaggctccctggctggccggtttgggcgtctgggccgtgaaggtgggacctc

SEQ ID NO: 26503 - DNA, 80 bp, Homo sapiens
aatactaggtttgagcaaaagtaattgcggttttgccatcatgccaaaagctacagttacttttgcaccagcctaatatt

SEQ ID NO: 26504 - DNA, 63 bp, Homo sapiens
ttgtacttcagaatctccaggagtaatgtatgaagttagtcctggagattctaaagtataaca

SEQ ID NO: 26505 - DNA, 62 bp, Homo sapiens
ggaggcagctctggggcagaggtgtggacaggagtctcccaccgccctggtgctggctcaga

SEQ ID NO: 26506 - DNA, 59 bp, Homo sapiens
gctggtggcccggcgcgctggaaccgcggcgacccgctccagcgcgggaccagcagcaa

SEQ ID NO: 26507 - DNA, 82 bp, Homo sapiens
gcttcgctcccctccgccttctcttcccggttcttcccggagtcgggaaaagctgggttgagagggcgaaaaaggatgaggt

SEQ ID NO: 26508 - DNA, 65 bp, Homo sapiens
atgggctattatagatgaaaactgcacaaggccagaaccagcaggcactcaataaacgttcatgt

SEQ ID NO: 26509 - DNA, 78 bp, Homo sapiens
ggtccggccgctgacgcgccgggtatatagccgggcatgcgcgcggtgccggggcccggacgcagtgaggggggtcgg

SEQ ID NO: 26510 - DNA, 58 bp, Homo sapiens
agctggcttccccactcccccggagggaaggcgcaggggaagtggggcagccggcaga

SEQ ID NO: 26511 - DNA, 86 bp, Homo sapiens
ccgcccctctgccccttcgcccctccgcccctccgctggccgaggggctgcgagggccgggcggcgaagatgcgtggggcgcggaa

SEQ ID NO: 26512 - DNA, 85 bp, Homo sapiens
ccggcgccacccagacccgcgagccgagaccctccccgcggcgtcgctgcgggaggggcggaagagcgcgggcggtgggcgggag

SEQ ID NO: 26513 - DNA, 63 bp, Homo sapiens
tccaaatatgtttggggacccactctgtgtctggctatagtgggtcctcaaacatggttggaa

SEQ ID NO: 26514 - DNA, 82 bp, Homo sapiens
gatcgtggtggactgtggtagcagtgggtctcgagtatttgtttactgctggccaaggcataatggcaatccacatgatctg

SEQ ID NO: 26515 - DNA, 52 bp, Homo sapiens
tgggcgccgcgccttccgccgaccccgcgagggtgcccggtcctcgccccgc

SEQ ID NO: 26516 - DNA, 84 bp, Homo sapiens
cggggcggcggcggccggagcccgaggagctgtagcagccttagtcgccgccgccgcggggcgaggtcgccgccatggcccgct

SEQ ID NO: 26517 - DNA, 62 bp, Homo sapiens
cagcccaaagtccagatttgtcatctaaatcaggtccagatgggaatgaggctttgggcgac

SEQ ID NO: 26518 - DNA, 62 bp, Homo sapiens
cccccaaagcccaggaggtcctggaggagtggccccccaggatctcctgggctttgggatca

SEQ ID NO: 26519 - DNA, 66 bp, Homo sapiens
gccgccgcgagtctggtatcctgagcttcgtgagttgagcgctgctgctccgcggtggagtcaccg

SEQ ID NO: 26520 - DNA, 66 bp, Homo sapiens
tggcatggttgggagcaattgttacttaacagttgggttacttatcagttgttcccaaccatgcca

SEQ ID NO: 26521 - DNA, 52 bp, Homo sapiens
cggccaggtgggcgccaaccgagcctcggcgggcggccggagcggagccggg

SEQ ID NO: 26522 - DNA, 58 bp, Homo sapiens
gccgaggacgagccacgcgcccaaagaaaagcgggtgcagtgctcagtgctcaggcct

SEQ ID NO: 26523 - DNA, 79 bp, Homo sapiens
ttgaggtagggaggcaaaggttttagaaagcaattaatgatgggtgcaattttctcttccttatatatcctttcttatg

SEQ ID NO: 26524 - DNA, 61 bp, Homo sapiens
aacagcttctctatgtgtggattcgtgtaaatgcgaagagttcacatataaagaagtgact

SEQ ID NO: 26525 - DNA, 65 bp, Homo sapiens
gcatagcacatactatagcatataaagcatagcatatactatggcatatagtgtggtctatagca

SEQ ID NO: 26526 - DNA, 82 bp, Homo sapiens
tccgacccccttcgctgctctccattcgcaatcgcccgcgggcgcctgcgcgatgggtcggccgtggggagcggggcgggaa

SEQ ID NO: 26527 - DNA, 75 bp, Homo sapiens
acctggtagcatttattttccctcaagtacctagtaaccttatgaaggtagggagggtagatgctctaccacatt

SEQ ID NO: 26528 - DNA, 79 bp, Homo sapiens
cggcagctgatgcgcgccccgccggccgggaggcgggagtccgcgagccgggagcgggagcagcagaggtctagcagcc

SEQ ID NO: 26529 - DNA, 53 bp, Homo sapiens
gcgggggcggggcgcccggaggctgcgcccgaggccgcccgcgttccgcgcct

SEQ ID NO: 26530 - DNA, 64 bp, Homo sapiens; identical to SEQ ID NO: 14355

SEQ ID NO: 26531 - DNA, 64 bp, Homo sapiens; identical to SEQ ID NO: 14355

SEQ ID NO: 26532 - DNA, 59 bp, Homo sapiens
ccagccgcacctgtgcaactgtggctgaaacgctgcggagaggccaggccaggctggag

SEQ ID NO: 26533 - DNA, 61 bp, Homo sapiens
ccaggcgcgggtgtgtgcgcgcgggcaggtgtgcgagtgtgcgcccgggcgcgcgccggcc

SEQ ID NO: 26534 - DNA, 64 bp, Homo sapiens
agctcctcctctcccgggtcgccgtctgacttaaacgcgtgagacgggagaggaggaacccccg

SEQ ID NO: 26535 - DNA, 64 bp, Homo sapiens; identical to SEQ ID NO: 26534

SEQ ID NO: 26536 - DNA, 52 bp, Homo sapiens
aggcagaccaggtccggatgctgcgagtgctgcgcctgtcccgggaccctcg

SEQ ID NO: 26537 - DNA, 64 bp, Homo sapiens
ggctcgcggcggcggcgggttgcgtcccccgcgcctgctggcccacgtggacctggccgtcgct

SEQ ID NO: 26538 - DNA, 62 bp, Homo sapiens
agtgccccgcggagagtcgagcttccttccccggggctgggggttccgcggagctcgctctg

SEQ ID NO: 26539 - DNA, 86 bp, Homo sapiens
cgagcgtcgtcggcaagcggccgcctttccacggtaaccgcgcgccggcggggagggcgtggcgcggagccgacgggaacgtccgc

SEQ ID NO: 26540 - DNA, 67 bp, Homo sapiens
gccccggcggccgtcgggttggcgggtcgtgctcgcgcgtcggccgcgcgccggcgggctgggggcg

SEQ ID NO: 26541 - DNA, 83 bp, Homo sapiens
ctctgcgcatgcccggaccccggcggctccggagtccgggaggctctggctgctccagtcgcgggtccgggccccgcctctcc

SEQ ID NO: 26542 - DNA, 71 bp, Homo sapiens
cgtcccggctgcgtcccgccggtcccgccccgccccgccccgcagagccgccgccagtagtgggagacgtg

SEQ ID NO: 26543 - DNA, 71 bp, Homo sapiens
acctgagccactgcacccggctaagcgttcctttttttaaaaaaaatcggccgggcgcggtggctcatgcc

SEQ ID NO: 26544 - DNA, 59 bp, Homo sapiens
gcggaggccctgagcccggcgagcaggagaggaggtcttccgggccgcggcctccgagc

SEQ ID NO: 26545 - DNA, 62 bp, Homo sapiens
ccacctccacggcggcgccagcgtccccccggggggcctgggcggcggcggcggcgggggta

SEQ ID NO: 26546 - DNA, 57 bp, Homo sapiens
gaggggaggaggcggggagcgcagccggcagcgacgaccccggccccctcccccagc

SEQ ID NO: 26547 - DNA, 63 bp, Homo sapiens
agcgggggcgagcatgcgcaccagggagacgacgctccctggtgccgcggccgcctccgcgag

SEQ ID NO: 26548 - DNA, 66 bp, Homo sapiens
gtgcaaaagtaattgaggtttttgccattgaaagtaatggcaaaaacctcagtaacttttgcacca

SEQ ID NO: 26549 - DNA, 56 bp, Homo sapiens
ccgccccgacgccgtggccagccctgcgacaaggctggactgggcggggggctgag

SEQ ID NO: 26550 - DNA, 90 bp, Homo sapiens
agccggcccggagcgctctgacttgcaagcgggctgcgctgcggagcccagtgcccgagtgacacccgcggagagtgcagggccggggaa

SEQ ID NO: 26551 - DNA, 55 bp, Homo sapiens
tacactgttgtggctggaacacacgaaacatcagtgtgttccagctgctgtggcg

SEQ ID NO: 26552 - DNA, 60 bp, Homo sapiens
gggggcggggccgcggcggaggcgaggttcctgcggtctcctcctggctgccacccctgt

SEQ ID NO: 26553 - DNA, 60 bp, Homo sapiens
ttcagccagaaagagtgccaagttggtgattataacttgggcattgtttctggctgaaca

SEQ ID NO: 26554 - DNA, 68 bp, Homo sapiens
gcaggggcgggcgcggagggcgggggcgcggtccgctagagccctcggcctcgctcccgcccctcccc

SEQ ID NO: 26555 - DNA, 56 bp, Homo sapiens
aagtagaagcttgcttctgagtagtgtcatttctactcataggctcctctgcttct

SEQ ID NO: 26556 - DNA, 52 bp, Homo sapiens
ccacggtccgcccgaggcttcggagctgccggagccgggcggggccttggcg

SEQ ID NO: 26557 - DNA, 54 bp, Homo sapiens
cccgcggcggcggcggcgtcctacgggcgggcgcggctcgctcccgggctggcg

SEQ ID NO: 26558 - DNA, 61 bp, Homo sapiens
tggccgggcgctgcctcctctcctcctccggtgcgaggtgtcctcggggagcccggcggtc

SEQ ID NO: 26559 - DNA, 63 bp, Homo sapiens
gcttcagatgggatcaggtggagttgctgaaaagttgccagctactgtatatatgaatttagg

SEQ ID NO: 26560 - DNA, 81 bp, Homo sapiens
agggccgtccccgggcaggatgacaagggtggctcggcggctccggcattgtgatcaggacttgcggggcgggggccccgg

SEQ ID NO: 26561 - DNA, 63 bp, Homo sapiens
cggggccgcggtggctgagtcacattcccggagccccgccacccaggacaccgcggccccggc

SEQ ID NO: 26562 - DNA, 79 bp, Homo sapiens
ggggaggccgtcaggacgcggccggaccgggcccagtgacccgcgggcggctccggccgcgcaggctgtggctccccga

SEQ ID NO: 26563 - DNA, 62 bp, Homo sapiens
tcccccacgggccgtgccgggcgggtgcgggtgtttacgcgccggccggccagctggggtgg

SEQ ID NO: 26564 - DNA, 57 bp, Homo sapiens
ggccgccggctgctgggggtgggagacttgctccctccttcagtcgcccgccgtcag

SEQ ID NO: 26565 - DNA, 58 bp, Homo sapiens
tccgcagcagggagagcccggcctgggacggcgggcgggttcccctctggtgcgcagt

SEQ ID NO: 26566 - DNA, 88 bp, Homo sapiens
ccagccgttgcagcccacagcgccgcccgcccgccgggcttcgggaggcaaaggtggcggcggcgcaccgcggagtaggggctgcggg

SEQ ID NO: 26567 - DNA, 84 bp, Homo sapiens
ggtcccggaggtggggttgcgctcacaaggggcgaccgtcgccacggtggcggccactgcatcgcgtcccacctccgcggccct

SEQ ID NO: 26568 - DNA, 85 bp, Homo sapiens
gggctgggcggcgcggcgccggcgctgagctcctgtggccgcgaggtgaatgggctcagcctgacgcagcccagctctagccccg

SEQ ID NO: 26569 - DNA, 50 bp, Homo sapiens
tgggctgcgtcaggctgagcccattcacctcgcggccacaggagctcagc

SEQ ID NO: 26570 - DNA, 50 bp, Homo sapiens
gtgtatatatatggtgtgtatatgtatatacacaccatatatatactctc

SEQ ID NO: 26571 - DNA, 58 bp, Homo sapiens
caaaagtaattgcagtttttgccataaaagaaatgacaagaaccgtaattacttttgt

SEQ ID NO: 26572 - DNA, 69 bp, Homo sapiens
acaccgggggttagagcttcaacctccagtatgatggtattgaggttagagcttcaacctccagtgtga

SEQ ID NO: 26573 - DNA, 63 bp, Homo sapiens
gcggaggggccccggcgcggagcggggttcacgcagccgctagcgcccaggcgcctctcgcct

SEQ ID NO: 26574 - DNA, 86 bp, Homo sapiens
ctcacctcattcatttaccttctcttacagatcacttttctgcactggacagtgatctgtaagagaaagtaaatgaaagaggtgag

SEQ ID NO: 26575 - DNA, 54 bp, Homo sapiens
gggctcccggtccggctgccgccgctcccccgctccggacccggggctccccct

SEQ ID NO: 26576 - DNA, 50 bp, Homo sapiens
cgcgtgcgcagagcacttccttgtttggccccgtgactgcagcgcgagcg

SEQ ID NO: 26577 - DNA, 57 bp, Homo sapiens
aggaacacaggaaataaagtgctttgactattttaatctctatttcttgtgttccct

SEQ ID NO: 26578 - DNA, 57 bp, Homo sapiens; identical to SEQ ID NO: 26577

SEQ ID NO: 26579 - DNA, 55 bp, Homo sapiens
agttctggttcaagcctgctgggaaatcctgcagctggctggctcacagaacagt

SEQ ID NO: 26580 - DNA, 64 bp, Homo sapiens
gcccagagcctgggaagtggccgcagaggctgctcggccccgctgcccgccaggtcgtgggctc

SEQ ID NO: 26581 - DNA, 52 bp, Homo sapiens
gggagcgcgctcgcggggggagcggggctgggcgcgcgggcggggtccgcgg

SEQ ID NO: 26582 - DNA, 51 bp, Homo sapiens
gtgcgcggcgtcggagcaagcggccccttccttcggccccgcccagccccg

SEQ ID NO: 26583 - DNA, 80 bp, Homo sapiens
tggggagagtgggccgggtgggaggcaggggcagtttgctgagccagctctcacatggacccgcgctttctctcccccag

SEQ ID NO: 26584 - DNA, 51 bp, Homo sapiens
ggggcgcaggcccagcgggctgtcgcacagctcggctgtcctgtgcccctt

SEQ ID NO: 26585 - DNA, 91 bp, Homo sapiens
cttctcagcgccctacgtggtccgtcccgccgtccaggcccgcgccactttcgcgttccctggggcggggcgggcggcgcgctgagcgcca

SEQ ID NO: 26586 - DNA, 58 bp, Homo sapiens
ccggcccggggtgtctgggaggctgccaggtgcctcccagagctcccaagggccccca

SEQ ID NO: 26587 - DNA, 53 bp, Homo sapiens
cctgctgcccttgccctaggcccccaaacccgggctctgggtcctggcagggc

SEQ ID NO: 26588 - DNA, 64 bp, Homo sapiens
tagtgaagattattgatcacattagtcgtgatcacattagttgcgatcgataaccttcaccaga

SEQ ID NO: 26589 - DNA, 57 bp, Homo sapiens
ctgctctggacgctgaggccccggcttctcttgctggggtgtcgattcgggagggct

SEQ ID NO: 26590 - DNA, 77 bp, Homo sapiens
atggggaagcaactgtcagcacctaatgggccctgtgacgaatagggcgggggtgctggcggagcttccgaatatcc

SEQ ID NO: 26591 - DNA, 57 bp, Homo sapiens
ctgggggaggttctgtgcagggccctgcccttggtccctgccggcccttcctcatac

SEQ ID NO: 26592 - DNA, 77 bp, Homo sapiens
gtctccccgcaccggggcccttgggtcgtctcagccctcgccgggatcctgtggcccacgtttgttgggctgggtgg

SEQ ID NO: 26593 - DNA, 57 bp, Homo sapiens
gctccgaggtgacggtgcgagccctgcccgagggctccctcgccttccccggagtga

SEQ ID NO: 26594 - DNA, 64 bp, Homo sapiens
cgcgggacgccgccgagttcgagctcttcttccgccgctgcccgttcggcggcgccttcgcctt

SEQ ID NO: 26595 - DNA, 64 bp, Homo sapiens
cggcggcggcgctcggcgggctcggggccggggggcggggctcagtccgcatgggcgccgcgca

SEQ ID NO: 26596 - DNA, 79 bp, Homo sapiens
ggggcagggtggtggcgggggagagggtaggggggcggggccgcagtgctcagctgtcttcccctcggccctgccccac

SEQ ID NO: 26597 - DNA, 78 bp, Homo sapiens
gggccagccgggggaggtgggtagcccgcggcctgctgacacgcaccctcctgcccacagaactcctccaaggcccgc

SEQ ID NO: 26598 - DNA, 54 bp, Homo sapiens
ccgcggggacagagtggccgccgggtgctggaggctccgctgcaccccgcgccc

SEQ ID NO: 26599 - DNA, 64 bp, Homo sapiens
ggagggagcagctgggccctgggcgctgaggcctgggtactggggctcagatgcttcctctcct

SEQ ID NO: 26600 - DNA, 87 bp, Homo sapiens
tgggtgggcaggctggagtaggagcgggagggcgaggtggggacgccctgccccagcccagcgcagcgaccaggtgccctcaccagg

SEQ ID NO: 26601 - DNA, 83 bp, Homo sapiens
gagcagcctgtgggcaccgcggcggtagttggaggcgggagagggtccgtagccgcgccgccctgccccgccatgggcctcct

SEQ ID NO: 26602 - DNA, 60 bp, Homo sapiens
ccacggcagctagcccgtcccgccaacccccacgctggggacgggctctctgccgttcgg

SEQ ID NO: 26603 - DNA, 56 bp, Homo sapiens
gggggtggggtgtgggaggtggggtgcagccccacagtcctgagctccaccccctc

SEQ ID NO: 26604 - DNA, 58 bp, Homo sapiens
taggcccagacctgtctgagtatggactgacagcaagctcagagaggtctggacctgg

SEQ ID NO: 26605 - DNA, 57 bp, Homo sapiens
ggggctccggggctccgggccgcacaatggccgcgcgcgggtgcctctgtccccaat

SEQ ID NO: 26606 - DNA, 66 bp, Homo sapiens
tgcgggtggaactcagggctgggagccaggtcctggcgcagtcagccctgacattctgctcgctca

SEQ ID NO: 26607 - DNA, 51 bp, Homo sapiens
tcccgcagggcctgctgggctgcgagacgctaagcggcgccgggcgggaga

SEQ ID NO: 26608 - DNA, 57 bp, Homo sapiens
gcctgactctgtggccttcctgagctgcctccccagtaggcctcagtgctgggctac

SEQ ID NO: 26609 - DNA, 57 bp, Homo sapiens
agggctctgctccaggtctgcatacccaccaagggctggcctgccgcagagctgtcc

SEQ ID NO: 26610 - DNA, 53 bp, Homo sapiens
cggcggcggcggctctgggcgaggcggcggggcctgggctcccggacgaggcg

SEQ ID NO: 26611 - DNA, 73 bp, Homo sapiens
ggcggcgggggcgagaagacaccgggtcggcaggggcccaggccccaccctgaccccgcctcccgctcgccca

SEQ ID NO: 26612 - DNA, 57 bp, Homo sapiens
ggcctcaagacaagtttcctgcagatgtctgcttgcaggtgccttcttggggtttcc

SEQ ID NO: 26613 - DNA, 57 bp, Homo sapiens
cccgcctgggcaacaagagcgagttgtcggagtctcactctgtcacccaggctggag

SEQ ID NO: 26614 - DNA, 90 bp, Homo sapiens
gaggccgcttggcgggagacacccaagggaacggcagcaccttgacaggtttgcttcactgcccttggctcctgccttgccggagtctgt

SEQ ID NO: 26615 - DNA, 68 bp, Homo sapiens
aagcggagcttcgctgcaggggccgaggccggacgagtccattcgcgtccgcggcggggcgcgcctga

SEQ ID NO: 26616 - DNA, 61 bp, Homo sapiens
cactgaaactcaagataggaggaacatttctcccacgttctccttactgtagtttcaggaa

SEQ ID NO: 26617 - DNA, 50 bp, Homo sapiens
tgctattacaaagttgcatatatatttgaaacttgtgcaaatttatccaa

SEQ ID NO: 26618 - DNA, 78 bp, Homo sapiens
cggcggcggcggcggcaccatccaggcgggcaccatgggcacgtccgcgctctgggcgctctggctgctgctcgcgct

SEQ ID NO: 26619 - DNA, 58 bp, Homo sapiens
gtggctgtgctggggtctcactcctgacacgggggctgccgctgcggcgccgccgccg

SEQ ID NO: 26620 - DNA, 68 bp, Homo sapiens
ctgcggcaggagctggggcggcctctccgggaaccctgagtcccgccccacagccttccactggagtc

SEQ ID NO: 26621 - DNA, 59 bp, Homo sapiens
cgaggtctctgtcccgggcggcgggagggaaatgccgcgcccgcagccagggacccgcg

SEQ ID NO: 26622 - DNA, 77 bp, Homo sapiens
tccaacgccccgatgcccctggcctgcatggctagtcaaagcggccggtggccggtgcgctggtggggaggacgatc

SEQ ID NO: 26623 - DNA, 79 bp, Homo sapiens; identical to SEQ ID NO: 14703

SEQ ID NO: 26624 - DNA, 74 bp, Homo sapiens
tgtctgggcgccaatcccgacgctgggcggagcgaggcccggtccctgcagcgggcgaaaggagcccgggcctg

SEQ ID NO: 26625 - DNA, 66 bp, Homo sapiens
tcccctattcttatatgtgctccagcttccccattgtccctggagcacatttaggaataggggaaa

SEQ ID NO: 26626 - DNA, 66 bp, Homo sapiens; identical to SEQ ID NO: 26625

SEQ ID NO: 26627 - DNA, 64 bp, Homo sapiens
cccctattcctaaatgtgctccagggacaatggggaagctggagcacatataagaataggggaa

SEQ ID NO: 26628 - DNA, 56 bp, Homo sapiens
cgggggggaggggagaggagggcacctaggctctcctcttctctcccccctcctcg

SEQ ID NO: 26629 - DNA, 58 bp, Homo sapiens
acgcaggagtcttgtatcttttaccagcgctggtaaaagatacaagactcctgcatca

SEQ ID NO: 26630 - DNA, 70 bp, Homo sapiens
tggtgcaaatgtaattgtggtttttgccaccgaaagaaatggcaaaaccccaatgacttttgcaccaacc

SEQ ID NO: 26631 - DNA, 57 bp, Homo sapiens
ctgcgcggcgcagacatggcctcttcctatctttgaggcggtgtctgcggcagcgcc

SEQ ID NO: 26632 - DNA, 52 bp, Homo sapiens
tcgccgctgcctcccacccaccccctcgacgggagggtgaggcgcggcgcag

SEQ ID NO: 26633 - DNA, 58 bp, Homo sapiens
cagagcccacattcctaaccacctttaaaaggaggtggttaggaatgtgggatctgga

SEQ ID NO: 26634 - DNA, 56 bp, Homo sapiens
agatcccacattcctaaccacctccttttaaaggtggttaggaatgtgggctctgg

SEQ ID NO: 26635 - DNA, 56 bp, Homo sapiens; identical to SEQ ID NO: 26634

SEQ ID NO: 26636 - DNA, 68 bp, Homo sapiens
ccccacgatatagggagtgatggccaccccctgtcccccctggctattacgatctacatcgcaggggg

SEQ ID NO: 26637 - DNA, 59 bp, Homo sapiens
gcggcggcggcggcggctgcagtagcagcagcagctactgcagcttccctccctccttg

SEQ ID NO: 26638 - DNA, 60 bp, Homo sapiens
aaggcactgactgtgcaggggacggagttcgtttctcatcccccactctcagtgcctcga

SEQ ID NO: 26639 - DNA, 57 bp, Homo sapiens
cgggtctcgggcggggcctgagtgcagctactcgatttccccgcccccggagccggc

SEQ ID NO: 26640 - DNA, 86 bp, Homo sapiens
ataatggtccatctccaggctcttgatgttatccacccacaaccccccacttctctcaaaaggatcctggtttggacaatacatta

SEQ ID NO: 26641 - DNA, 91 bp, Homo sapiens
aaggaacaggggacacttgtaatggagaacactaagctatggactgctatggactgctagtgctctccgttacaagtatcccctgttacct

SEQ ID NO: 26642 - DNA, 74 bp, Homo sapiens
cccaggaaggatcccagccagttttggtgctggaggcccggccaaaggaagggctgctctcccgtcccgcgggc

SEQ ID NO: 26643 - DNA, 61 bp, Homo sapiens
ctagggatttggatgtgaacagttcccccttcaaaaaatgttcacatccaaatccctagaa

SEQ ID NO: 26644 - DNA, 57 bp, Homo sapiens
gatctcagcactgctcctcttctaggctgaagcatggaggagtactgatgagatctc

SEQ ID NO: 26645 - DNA, 72 bp, Homo sapiens
aaaagctgtccactgtagagttgctgtatgtagcaatgtgtatccactctacagtggtcagcttttagtaga

SEQ ID NO: 26646 - DNA, 63 bp, Homo sapiens
cgtgggcagccggcgggctccgaggccgtgagcgcaaagcctcaggccccggctccctcctga

SEQ ID NO: 26647 - DNA, 59 bp, Homo sapiens
agggagctccattcccattgtagtctatgtctgtacaatgtgtgaatgacactccctaa

SEQ ID NO: 26648 - DNA, 90 bp, Homo sapiens
agtatcctgtggagcacccagacaaattcctgaagtttggcatgacaccttccaagggagttctgttctatggacctcctggctgtggga

SEQ ID NO: 26649 - DNA, 58 bp, Homo sapiens
ctggtactgcgtctgtggtgaacctgacagcaggtaggccggatgctagcttccgggt

SEQ ID NO: 26650 - DNA, 65 bp, Homo sapiens
gccaggtcccgccggccggctccggggcagcgcccgcgcccaggtgccagcccgtgggaaggtga

SEQ ID NO: 26651 - DNA, 73 bp, Homo sapiens
gccccgcgcgcgccgctcgtccgggtcaggtcgcctcggcccggcccgtctccgctcgctgcgccggcggccg

SEQ ID NO: 26652 - DNA, 68 bp, Homo sapiens
aagcctgtccctaaatccttcctggcaccaactctggaaggctgggagggacttagggacaggctttt

SEQ ID NO: 26653 - DNA, 64 bp, Homo sapiens
gttatcattgttttagtgtttgtactgataatgtggaagcaaacaccaaaacaatgaaaacaga

SEQ ID NO: 26654 - DNA, 64 bp, Homo sapiens; identical to SEQ ID NO: 26653

SEQ ID NO: 26655 - DNA, 69 bp, Homo sapiens
cgcttatcctcgggcgccgccgccgtgttctcagagtgctgcggcgaactggctggaggagctagggga

SEQ ID NO: 26656 - DNA, 82 bp, Homo sapiens
tagcagtgcccaggtagagtgtaggcccagctttctctatctgcctcagagggaaacatggactggcacactgctccactgt

SEQ ID NO: 26657 - DNA, 55 bp, Homo sapiens
tagccagagttcctgaagaaactgggactattttctttaggaactctggctaact

SEQ ID NO: 26658 - DNA, 57 bp, Homo sapiens
gttagccagagttcctaaagaaaatagtcccagtttcttcaggaactctggctaact

SEQ ID NO: 26659 - DNA, 58 bp, Homo sapiens
ttctggtactctgcatgagggacaaacattcagaccctcatagcagcgttctggaatc

SEQ ID NO: 26660 - DNA, 70 bp, Homo sapiens
tcccgcgctccgccgcgctgtgcgaggcccagactgagggcgaaacagcaggcaggactgggtggagacg

SEQ ID NO: 26661 - DNA, 78 bp, Homo sapiens
cggccgggacgcggagctgtgtgcatctcctacgcgggctcgctcgctcccgggagccgcgcagcttccccggcggtg

SEQ ID NO: 26662 - DNA, 60 bp, Homo sapiens
cgcggggcggggcggagcactcggcggagccgctctgcctgcgtccgctcttcccgcagc

SEQ ID NO: 26663 - DNA, 66 bp, Homo sapiens
ttactaaaccctagggtcagtggtgagccagctccaactcaccactagccttagggtttagtaatc

SEQ ID NO: 26664 - DNA, 72 bp, Homo sapiens
cgcgcagacttgcgcacgcgtcgtgagagcgaccgcctccgtctctcgctgggctcgctagggctgcgcgtt

SEQ ID NO: 26665 - DNA, 66 bp, Homo sapiens
cggcccccgcgggctctgcggacgcctactgctcccgcaccctcggcagagtccgcgggcgcagca

SEQ ID NO: 26666 - DNA, 67 bp, Homo sapiens
gcagacaggcacagcccgggagcggcggacgccagcgccggcgccgcagggagcgcgtgcggggctc

SEQ ID NO: 26667 - DNA, 70 bp, Homo sapiens
ggaacaaggcgggggttcggggccggctgcagactctcaccgcagcggccaggaacgccagccgttcacg

SEQ ID NO: 26668 - DNA, 70 bp, Homo sapiens
tgcgctctgaaaggccgggtcccgcgttccggtcgatcggtgttccccgggacccgctcctcagggctga

SEQ ID NO: 26669 - DNA, 70 bp, Homo sapiens; identical to SEQ ID NO: 26668

SEQ ID NO: 26670 - DNA, 63 bp, Homo sapiens
aggggcgggtgttccgcgcgctgccggtcccttgtacccagcagccccggccaccgcccctcc

SEQ ID NO: 26671 - DNA, 81 bp, Homo sapiens
cggccgggacaggaagaggctggggaccgcggcgaaggtggtgagtgctcttgggcgccttctcccaacgtccctgccaga

SEQ ID NO: 26672 - DNA, 52 bp, Homo sapiens
gctccaggtgtcgggcgccgggtctggccaccgggcgcaaccgtcggagcgg

SEQ ID NO: 26673 - DNA, 58 bp, Homo sapiens
tgacttctgccttcccagagtgttctagaaggtgagctctgagaaagcaggggtgagc

SEQ ID NO: 26674 - DNA, 51 bp, Homo sapiens
tgcccttccacgacccctaccggcagtgagtgggggtcctgggggggcggg

SEQ ID NO: 26675 - DNA, 68 bp, Homo sapiens
gtcgcggggctcctggcgcccccctagacgactgtgtggagaatggagcctgcggagccacgcgtaga

SEQ ID NO: 26676 - DNA, 82 bp, Homo sapiens
gacaaattttaaatgtccctgtccccttccccccaattaaagtagattgggggaaagcgagtagggacatttaaaatttgtt

SEQ ID NO: 26677 - DNA, 72 bp, Homo sapiens
ctcggcagcctcagtccgtccgcctgcctcgcactgggggctcggccgggcggtgacggggctggtccagcg

SEQ ID NO: 26678 - DNA, 57 bp, Homo sapiens
gcggcggcaggtgtagaggagcccgggtggggcgcgcctctctcctcccgccggaca

SEQ ID NO: 26679 - DNA, 54 bp, Homo sapiens
cggcgggaggagagaggcgcgccccacccgggctcctctacacctgccgccgcc

SEQ ID NO: 26680 - DNA, 68 bp, Homo sapiens
tccggacgccgtgcgcgtgcgcgcggcaggtcggcgccgggcgggggcggagcggccgtcgcaggtcc

SEQ ID NO: 26681 - DNA, 72 bp, Homo sapiens
tttggcagcacaggcagctccaggtgccagcacaggtgctggctccctgcaaggctgcagctggaccagatg

SEQ ID NO: 26682 - DNA, 68 bp, Homo sapiens
agtcgccgcggcggggtcgagcgggggcggcagctgacaggcgctcctcccccgaccgcagcggctgg

SEQ ID NO: 26683 - DNA, 61 bp, Homo sapiens
ctcagtctcctgtgcagacctgtttcaactccctgtacaggtttgtccggagactgaaggg

SEQ ID NO: 26684 - DNA, 61 bp, Homo sapiens; identical to SEQ ID NO: 26683

SEQ ID NO: 26685 - DNA, 53 bp, Homo sapiens
tgctagtggcacacagtgcttatctgcataaataaacactggccaccagcagt

SEQ ID NO: 26686 - DNA, 56 bp, Homo sapiens
gccgccgcccaggccccgcgcccgccgcccgcgccgcgcctgaggtgatgcggacc

SEQ ID NO: 26687 - DNA, 97 bp, Homo sapiens
acctctctaacaaggtgcagagcttagctgattggtgaacagtgattggtttccgctttgttcacagtggctaagttctgcacctgaagagaaggtg

SEQ ID NO: 26688 - DNA, 68 bp, Homo sapiens
ctccggtgcctactgagctgatatcagttctcattttacacactggctcagttcagcaggaacaggag

SEQ ID NO: 26689 - DNA, 63 bp, Homo sapiens
agagccaggggacgctgtgtgaggctggcaaagcggtgttcacctagttctctcgggctccgc

SEQ ID NO: 26690 - DNA, 56 bp, Homo sapiens
ggagggcgcgcttgacctggggctggggtccagccctgcccgccggtgccgtctgc

SEQ ID NO: 26691 - DNA, 62 bp, Homo sapiens
ctggcacaggggttgtaataccgttgggaattgcccatgatattgcagtcgctgtgccagga

SEQ ID NO: 26692 - DNA, 60 bp, Homo sapiens
tcccgcgggaagggcggcggggcgggtcgaggaagctccgcggccctctcctgtgcgagg

SEQ ID NO: 26693 - DNA, 87 bp, Homo sapiens
ggaggcggcggcggctctgggcgccgggagtcggcgggcggcgaggagcgcggagccggagctggacgccgccgccgccaccgccac

SEQ ID NO: 26694 - DNA, 59 bp, Homo sapiens
cccgccccttctccattcaacgccgcgcggggcggggcagggcgcgcggggcggggcgg

SEQ ID NO: 26695 - DNA, 61 bp, Homo sapiens
ttgctgcacctccaaagttttgttctttccactgaatattccactattaggtcagcaggct

SEQ ID NO: 26696 - DNA, 64 bp, Homo sapiens
cgccgccgctgcaggtaggaggctccccttccgggcgggccgcagccgggcgggggcgggggtg

SEQ ID NO: 26697 - DNA, 79 bp, Homo sapiens
cgcgcccagacctggggccccggtgaggttctagcgtgagccccggaaccccaagacaggggtacccggaacgcgcgtg

SEQ ID NO: 26698 - DNA, 75 bp, Homo sapiens
cgctgctcctgctgctactgacggggcccgccgcctgcgcagccagccccgcggacgacggtgcgggcccggggg

SEQ ID NO: 26699 - DNA, 68 bp, Homo sapiens
ccccggggtgcccggggggccaggcgcgcctgactttctcccttgggcaccgtgcgtggggtcggcgg

SEQ ID NO: 26700 - DNA, 65 bp, Homo sapiens
tgcaacagtaattgcagtttttgccattactttcaacggcaaaaaccgcaaattactgttgcacc

SEQ ID NO: 26701 - DNA, 58 bp, Homo sapiens
cttagactaccagactccctgaaactgcatgtcctcagggagtctggcagtctaagag

SEQ ID NO: 26702 - DNA, 63 bp, Homo sapiens
tgtgcgcctgcgcggaggcgtcggctgctgacgtgtagctggggccagacgggactagccggg

SEQ ID NO: 26703 - DNA, 84 bp, Homo sapiens
atggagggaggggctggcatcagtccccgctgctctgaggacacccggcttgggacgcgctgatgccagcccctacctccatca

SEQ ID NO: 26704 - DNA, 58 bp, Homo sapiens
gttggggagagatgaagaccctgtggaccagggctcactcttcttctcttgttccccc

SEQ ID NO: 26705 - DNA, 77 bp, Homo sapiens
cgcggcggcggcggcggctccggccccggtcccagccccggccccggcgcgggcgccgctccagccgatgtcgctct

SEQ ID NO: 26706 - DNA, 68 bp, Homo sapiens
ggctttgtctgcccaaagagtggggcgcgggcctcgggcaccgggcgccgcggagcagacaaaggatg

SEQ ID NO: 26707 - DNA, 53 bp, Homo sapiens
agctgagcgcagctggacccagcagccgctgtctccagtgccgcagcagcagg

SEQ ID NO: 26708 - DNA, 71 bp, Homo sapiens
gtcgggtcgatccgggtgggaacccagatgtctccaagatccgagacagatccccgccccgcgccctccct

SEQ ID NO: 26709 - DNA, 82 bp, Homo sapiens
acggaggcggaggccgcgggcaccgcgctggccccacaggtgccgcggagggtggcaggcccgctggccgaggcactgccga

SEQ ID NO: 26710 - DNA, 56 bp, Homo sapiens
cccagtgcggctgaggaggggaacacccaggtccttcagcggccgccgcccacgct

SEQ ID NO: 26711 - DNA, 70 bp, Homo sapiens
cggcgggcggcggaggaggagacggcaggtcgggtagggccgtgtttcccctcctcctcctcccaccctc

SEQ ID NO: 26712 - DNA, 98 bp, Homo sapiens
aagtcacgtgctgtggctccagcttcataggaaggctcttgtctgtcaggcagtggagttacttacagacaagagccttgctcaggccagccctgccc

SEQ ID NO: 26713 - DNA, 60 bp, Homo sapiens
ttggcagagccccagccttggagccaatcagaccagggttcaaagcttggctctgccacc

SEQ ID NO: 26714 - DNA, 89 bp, Homo sapiens; identical to SEQ ID NO: 14989

SEQ ID NO: 26715 - DNA, 56 bp, Homo sapiens
cccaggaggtggagtgcagtgaactgagactgtaccactgcactccagcctgggtg

SEQ ID NO: 26716 - DNA, 58 bp, Homo sapiens
gcggaggcggtggaggaggtgctgggagcagccgggcagccgcttcccgcccccgagc

SEQ ID NO: 26717 - DNA, 52 bp, Homo sapiens
gggccgcgagcggagccggctgagcgggcgccgagctcccgccatggcccgg

SEQ ID NO: 26718 - DNA, 70 bp, Homo sapiens
cccggggcggtgcgcgcgctcattgggctctgcgcctcccgccgccgccgccggcaccgcccccggggcc

SEQ ID NO: 26719 - DNA, 57 bp, Homo sapiens
aggaggcggcgcggcggccgcgtgagggcagcgggcgccgccgcctccgcctccgcc

SEQ ID NO: 26720 - DNA, 60 bp, Homo sapiens
gcgagccccttgctgtatggagccttgtttcagaaaggggcctcctgtaacgggctctgg

SEQ ID NO: 26721 - DNA, 56 bp, Homo sapiens
gccaggcaggccagccaggtccccgaggccggcccgggctggcacctgcctggaga

SEQ ID NO: 26722 - DNA, 69 bp, Homo sapiens
ggggagaggggcgggacgtgggctgcggcgcgcgagccgagcggccggccgaggcccgagcccacccga

SEQ ID NO: 26723 - DNA, 75 bp, Homo sapiens
tcagcagccgcccgcctccaggctgtcgtgaccctgggtgccgcggcggggggagtgctgggcggctggctggtg

SEQ ID NO: 26724 - DNA, 62 bp, Homo sapiens
cagggcacgcactggccccggcgcccacccgcacccctccccaggtcagtgcgtgcccgcgc

SEQ ID NO: 26725 - DNA, 83 bp, Homo sapiens
tcccaggcctgggccgggccgtgacggcggcgctaggacccggcgggccgcgggtgcggcgaggcctgggcggcctgaggagc

SEQ ID NO: 26726 - DNA, 68 bp, Homo sapiens
caagcggcgcctcgcagcatcgggctctggctgcagcgtcggggccgcagggggcggcgctgctgctc

SEQ ID NO: 26727 - DNA, 79 bp, Homo sapiens
gtcatgggtctgggctttgtggcggtgggggcagagggagatggtagcctgtccagccaccagcccctctccagggccc

SEQ ID NO: 26728 - DNA, 62 bp, Homo sapiens
aggtgagaggtggggtgggcctggagtgcgccacttctgcccccatcctgctctctcccaga

SEQ ID NO: 26729 - DNA, 87 bp, Homo sapiens
ggggtggggtgggtggggtcgggtggtggagaggccttagctgtcctggctggtgcccctcccaggctccttttcaccctgccccct

SEQ ID NO: 26730 - DNA, 80 bp, Homo sapiens
tgcccgcgcgcgaccggcgaccccgccccgcgcccctgtccctaaagggaagggcgtcccgccgggcgtcgcggggccta

SEQ ID NO: 26731 - DNA, 71 bp, Homo sapiens
ctcctcgccccttcccccgccaccccgtccgggccccgcggcggggcgcgttggcgcggggagggactgca

SEQ ID NO: 26732 - DNA, 55 bp, Homo sapiens
ggctcggcttcgccctgcgatcccgcccgcgaccgctgggcgccgtccgagttcc

SEQ ID NO: 26733 - DNA, 60 bp, Homo sapiens
gaagcgggtgctctcggctagggagtgggcagcgagaggggccgagggctccttaccggg

SEQ ID NO: 26734 - DNA, 65 bp, Homo sapiens
cggccgcgggcctccgtgcctgcctggccgaggctggcggcaggtcctgaggtctgaagcacgcc

SEQ ID NO: 26735 - DNA, 60 bp, Homo sapiens
ggcgctgggcgggcgcgccgggcctggggaaggggcgggcgcggggacccgatgcgcggg

SEQ ID NO: 26736 - DNA, 73 bp, Homo sapiens
taagcgtgcgccactgtgcccagcctgctaattaaaaaaaaaataaggctggacgtggtggctcatgcctgta

SEQ ID NO: 26737 - DNA, 65 bp, Homo sapiens; identical to SEQ ID NO: 15041

SEQ ID NO: 26738 - DNA, 59 bp, Homo sapiens
aaccccagactgggaggacctgtggccctgcaggtccagcccagaacctgggctccaag

SEQ ID NO: 26739 - DNA, 62 bp, Homo sapiens
gccggccccgcgcccgcgctgcgagccttccatggtgcagcgcatgtgggccgaggcggccg

SEQ ID NO: 26740 - DNA, 81 bp, Homo sapiens
caggcggcaggggttggtatccgagcagggatccgaggctgtccccagcctcggcctctcaccccggtgttgctgactgcc

SEQ ID NO: 26741 - DNA, 54 bp, Homo sapiens
cctgcctgtgtccccagtgtctgttccatcaggcagtggggacacaggcagact

SEQ ID NO: 26742 - DNA, 86 bp, Homo sapiens
agcctgggcacagggcctcactgcaatccctgcgccccgcctccctgggggatttccaggggttgtcctgctgcttggtgagctgg

SEQ ID NO: 26743 - DNA, 50 bp, Homo sapiens
ttggctaatcgagcgcgcgggctggcggctcggcgttcgtttggccgcgc

SEQ ID NO: 26744 - DNA, 59 bp, Homo sapiens
gcccgcggggccgggtgcgatggcggcggtggctgcgttgcagctggggctgcgggcgg

SEQ ID NO: 26745 - DNA, 65 bp, Homo sapiens
catggccggaggcggggccgggcccggattagtgcctggctgcctgtcctgccggcggccgtggc

SEQ ID NO: 26746 - DNA, 72 bp, Homo sapiens
cctccgagacgcgacctcaggaggcgcgaagttggccaaagtcccctcagcctgggtcgcgccgccgccgcc

SEQ ID NO: 26747 - DNA, 53 bp, Homo sapiens
cgccgcggctcctgccccgcccgagacaaaggcccggcggggtcgctcgctcc

SEQ ID NO: 26748 - DNA, 78 bp, Homo sapiens
ctcccagggacgtgcaggcagttggcagaggtgtgacctgcctcctccgccaactgccgtgcggccctgggaagagct

SEQ ID NO: 26749 - DNA, 76 bp, Homo sapiens
ctgcatgtcacaggcagattcctgggctccacctcagggactgagggactcaggaatcggcctgtggcatgcagtc

SEQ ID NO: 26750 - DNA, 67 bp, Homo sapiens
tgagggctgctgggtgcctggagcgcgtatgtccccaccggggcaggccagccccgcactccacccg

SEQ ID NO: 26751 - DNA, 86 bp, Homo sapiens
ggggctgggcgggcggggcgcgggccgagcggtggcggcggcgctgcgccgagtcagcgcccgtcgcgggccccccgccacccccc

SEQ ID NO: 26752 - DNA, 51 bp, Homo sapiens
cggtggcggcggcggcgcgcggaggccgcggcgcggcgagttgttgcaaaa

SEQ ID NO: 26753 - DNA, 58 bp, Homo sapiens
agcaggctgggcactgaggggtgagaccctggccgcccccatgtccaacccacgctgc

SEQ ID NO: 26754 - DNA, 70 bp, Homo sapiens
ttggagcgggtccctggcagtgggcagggctggcccgcccctgcagagtgaaggatagcccgggtttggg

SEQ ID NO: 26755 - DNA, 77 bp, Homo sapiens
gcacgaggtcggcggcgccgtccggcggggcctccatcttcctccagccctcggcggcggcgcggccgctcgcgtcc

SEQ ID NO: 26756 - DNA, 54 bp, Homo sapiens
tcggtcatccaggaggtggccgcccccgagccgctgcccgccgatggccagagc

SEQ ID NO: 26757 - DNA, 73 bp, Homo sapiens
acagggccctgccaggaggcccttgtggtcaaaccgttggcttttgtggggcacagtggcatgggctttggct

SEQ ID NO: 26758 - DNA, 51 bp, Homo sapiens
ggcattcatcccactggggtgcgccagggtggacaggtggagtgtggcctg

SEQ ID NO: 26759 - DNA, 81 bp, Homo sapiens
tggggtgcagactcccggggggacctcgtcacaggccctgctggagggcttggcgcgcttcccccaagtctgggcctgact

SEQ ID NO: 26760 - DNA, 53 bp, Homo sapiens
tggccgggggctgggggtcctggggatgccccagaggcccagccctggcacct

SEQ ID NO: 26761 - DNA, 75 bp, Homo sapiens
ccgggctgactccgcttctgggcggccgggcctccgcgagtaccgggtcgacttcggagtctgcgagcccagcca

SEQ ID NO: 26762 - DNA, 55 bp, Homo sapiens
gggtggggcgtgtggggcagcagggtgagcctctcactgccctgctcttacccct

SEQ ID NO: 26763 - DNA, 65 bp, Homo sapiens
cagtggggttggaccccagccgtgggtggtgtgccatgcctggcccaggggccgtgcccactgac

SEQ ID NO: 26764 - DNA, 58 bp, Homo sapiens
cattattactcacggtacgagtttgaagtgtcacagcgcgtaccaaaagtaataatgt

SEQ ID NO: 26765 - DNA, 55 bp, Homo sapiens
ggccctggcctggatccatgctgggcagaagcagctggacactgaccaggacccc

SEQ ID NO: 26766 - DNA, 55 bp, Homo sapiens; identical to SEQ ID NO: 26765

SEQ ID NO: 26767 - DNA, 79 bp, Homo sapiens
gcagaggggtgttggctgctcccagggtggctggctcggggccagagccctggtgggagcccagcctgcccctctagtg

SEQ ID NO: 26768 - DNA, 59 bp, Homo sapiens
agatgggcgggcagggccagtgcgagcaggtctggcacacacctgaccacccactctcc

SEQ ID NO: 26769 - DNA, 62 bp, Homo sapiens
tgcagggcgggtgtgggcagcagcgggcgggcggccggctcacccaggcgctgttctgcagc

SEQ ID NO: 26770 - DNA, 61 bp, Homo sapiens
ccctgcagacacgcagccccgtggaactcccggcgggacggttggggctggaggaacagga

SEQ ID NO: 26771 - DNA, 71 bp, Homo sapiens
gcccggtgtctgcgtggcccatcaggggagacgggacgcggtgcccagggagggcttctcgcgggcagcct

SEQ ID NO: 26772 - DNA, 74 bp, Homo sapiens
tgcaggtggtggaggtgggcgcactcctgcctgggcgtccctgccgcagcctccccctccaccgcccctgcagc

SEQ ID NO: 26773 - DNA, 79 bp, Homo sapiens
atggcttcggagcaggacgtgcgcgcccggctgcagcgcgctggccaggagcacctcctgcgcttctgggccgagctgg

SEQ ID NO: 26774 - DNA, 54 bp, Homo sapiens
cagcgggtgccggcgcagccaggcgcagagcgggcgcagcgcgcacccgcagcc

SEQ ID NO: 26775 - DNA, 88 bp, Homo sapiens
cggcggcgcggcgggggcgcggcgggggcgcggctgctggagcggtaccgccgcgtgcctggcgtgcgcgccctccgcgccgacagcg

SEQ ID NO: 26776 - DNA, 54 bp, Homo sapiens
gccgcgttcgcagcatggccgccctggggcggccgggctcggggccgcgcgctg

SEQ ID NO: 26777 - DNA, 70 bp, Homo sapiens
gcccgtgccccctctgacagccatcctcctgggagcccaggaaggcatccacgagggagctcctggccag

SEQ ID NO: 26778 - DNA, 63 bp, Homo sapiens
ctggtcacagcgtggcagcggaggccctcgaagccctggtcccctgcctcacggtgaccagca

SEQ ID NO: 26779 - DNA, 72 bp, Homo sapiens
gcgcccgtccggggcggggctgcctccctgcgcaccggccgcggtgactcagccccggcccgcccgggcccg

SEQ ID NO: 26780 - DNA, 62 bp, Homo sapiens
cagcggggttgcacctggcgcttggcgcccgcacctctgcccgcctcggagaccccgcagcc

SEQ ID NO: 26781 - DNA, 87 bp, Homo sapiens
tacgtctgcgcctgcgcctgcgcccgcgcctgcgcgttggagctcgaccggtgcggcgcctgcgcactggaaccaggcgtgcggcgc

SEQ ID NO: 26782 - DNA, 64 bp, Homo sapiens
cccgggccatggccgccgccgatgccgaggtgagcagcggggccggcggggggcggcgcggggg

SEQ ID NO: 26783 - DNA, 69 bp, Homo sapiens
ccgcgcgcgccgctcgcccttggcgccggcgcactccttgctcggatcctggtgccggtgcgcgcggtg

SEQ ID NO: 26784 - DNA, 56 bp, Homo sapiens
tacggtcaatgctctgaaatctgtggagcaaaccacagtttcatgcccatcgtcct

SEQ ID NO: 26785 - DNA, 73 bp, Homo sapiens
aaggacaggcccatttgagtattttgttttcaattagggagatagttggtattaggattaggattgttgtgaa

SEQ ID NO: 26786 - DNA, 76 bp, Homo sapiens
ggtgctgaggtcgcctcggtgctgagacctcctaggtattgaggtcgcctcggtactgaggttgcctcggtgctga

SEQ ID NO: 26787 - DNA, 59 bp, Homo sapiens
cgccgcgctctcggggcagggccgggccggggccggcggggcgctgcaggcgtggcccg

SEQ ID NO: 26788 - DNA, 66 bp, Homo sapiens
ccgctgggggttccgcggcagccttgaccttgtgaaggtcaggccgctgccagtacccgagcgggc

SEQ ID NO: 26789 - DNA, 53 bp, Homo sapiens
gctcagaagtgcggacgcccggctcccggcgtggacgccatggtgctgtgccc

SEQ ID NO: 26790 - DNA, 70 bp, Homo sapiens
tctgtcgtccaggctggaatgcagtggtgtaatcaatgtccactgcagtctcaaccacctgggctcaaac

SEQ ID NO: 26791 - DNA, 59 bp, Homo sapiens
agcctgggaagtggaggctgcagtgagctatgatcacgccactgcacttcccaggctca

SEQ ID NO: 26792 - DNA, 92 bp, Homo sapiens
ccccgcgcgcgccgcctcctccgccagcactaaggcccggcgcccggggcgcgggggcggccgcggggagccgcccgccgctcctggcgcat

SEQ ID NO: 26793 - DNA, 92 bp, Homo sapiens; identical to SEQ ID NO: 26792

SEQ ID NO: 26794 - DNA, 87 bp, Homo sapiens
gaggcagctgaatgaggagctctgcgccctccgtgagctgcggcagcggttggaggacgcccagctccgtggccagactgacctccc

SEQ ID NO: 26795 - DNA, 58 bp, Homo sapiens
ccgctgacagctgttgggggctgcggaggccgaacgcgcccacgacaggtgtcaggct

SEQ ID NO: 26796 - DNA, 62 bp, Homo sapiens
ggtccacctaagtctccgggagctgagccacatcttgcagctcctcagatttgggtggcggg

SEQ ID NO: 26797 - DNA, 72 bp, Homo sapiens
aagggaaaatagttgatgaccaactgaagcaatcagagctcaccatcttggtcttcagctgttttccctgga

SEQ ID NO: 26798 - DNA, 59 bp, Homo sapiens
agatgaggctggcgagggcaggggtgacatcctacctccgctctcagcctctcatctgt

SEQ ID NO: 26799 - DNA, 79 bp, Homo sapiens
ccccgccccccgcgcggccggcccgcgtgccctgcggttgccgcgagcacgccctttgaccgccgccgcgtgcggggcc

SEQ ID NO: 26800 - DNA, 74 bp, Homo sapiens
taggttgggagtgagaggtggtggcctggtgcagtgcatcagtggcctctggttgcctccacctccagcccctg

SEQ ID NO: 26801 - DNA, 69 bp, Homo sapiens
ccgccagctctccagctgcccagcgcggcgtggcgcgtcgggcgctcggcggcggcgaggctgggcgcg

SEQ ID NO: 26802 - DNA, 86 bp, Homo sapiens
cgccgcgtgagaaccggtgcgcctatcgcacgtgcacgccctgcgtgcgctgtgcgtggaagcggtgcgcctatcgcacgtgcacg

SEQ ID NO: 26803 - DNA, 69 bp, Homo sapiens
cgccccaacctcagcttctgggcctcgcctactttcaggaagggcgagcccaacagatctgggggcgtc

SEQ ID NO: 26804 - DNA, 52 bp, Homo sapiens
cgggacggcactcggcaggctcctcggacgtctacgagcagccgctcccggc

SEQ ID NO: 26805 - DNA, 59 bp, Homo sapiens
gctacggtaatctttatacttattgagacatatattgtttttaagtaaaacttgtatac

SEQ ID NO: 26806 - DNA, 97 bp, Homo sapiens
caagttggcactgtagaatattgaggaaaagatggtcttattgcaaagattttcaataagaccatcctttcctcaatattctgtggtgtcatctttg

SEQ ID NO: 26807 - DNA, 56 bp, Homo sapiens
aggtccggggtggaatcgacgtcgctgcggctgccgacgacccacacccggccggc

SEQ ID NO: 26808 - DNA, 67 bp, Homo sapiens
aggccacgcactttttcctcgcttcctctgccctttctggaaacaagggatgaatgtaaagaactgg

SEQ ID NO: 26809 - DNA, 54 bp, Homo sapiens
ggccgccttagcgcccggtgcttgggtcggcgccgggagcgaggagcgagctac

SEQ ID NO: 26810 - DNA, 53 bp, Homo sapiens
gagtaggggccaaggcatggccctgccactgccatgccttggctcccactcaa

SEQ ID NO: 26811 - DNA, 86 bp, Homo sapiens
gcggcggctgtggcggcggcagcggcggtgactgaggatagagagccacagcacgaggagctgccaggcctggacagccagtggcg

SEQ ID NO: 26812 - DNA, 57 bp, Homo sapiens
gaagacagagcggctgagcccagacctcctgaccctgggacctgcactgccttcatc

SEQ ID NO: 26813 - DNA, 54 bp, Homo sapiens
tggggcggcaggtgggttgcatggagccaggctgaccctccatgtccccccagg

SEQ ID NO: 26814 - DNA, 60 bp, Homo sapiens
ccgcgcgcgggtccagctgcgcagtctccaggctgcgggcggccggacccacccgcgggg

SEQ ID NO: 26815 - DNA, 60 bp, Homo sapiens
cggcgggggcggcgcgcgctcgttggaacagcccaggcggctgcagccccgcccctcgcg

SEQ ID NO: 26816 - DNA, 57 bp, Homo sapiens
gcctgcgcgtcggagcccggggaggtcggctcgtctcatcggggttcgccgcaggct

SEQ ID NO: 26817 - DNA, 50 bp, Homo sapiens
caagagagggaatgactgggcttcccttacatcccccgcctccttccctc

SEQ ID NO: 26818 - DNA, 56 bp, Homo sapiens
ggctaattatttgtatttttgttagagacagggtttcaccatgttggccaggctgg

SEQ ID NO: 26819 - DNA, 57 bp, Homo sapiens
ctacttcctggtaaacccattgtaatgtgcaaattacgggtttatcaggaggtgacc

SEQ ID NO: 26820 - DNA, 67 bp, Homo sapiens
cccgggggagccggcgctctaggcgaggaacccgtcagcccgcctacccgcccgtcgtctttggcgc

SEQ ID NO: 26821 - DNA, 59 bp, Homo sapiens
tctggaattaatgagaggagaggtgaagactcccttggtatcacattattgaaacagaa

SEQ ID NO: 26822 - DNA, 57 bp, Homo sapiens
cctagttcatctggatggactcttgttattataagattagttttaatgaattattta

SEQ ID NO: 26823 - DNA, 69 bp, Homo sapiens
agagttgggagagaagagaagagtgcttggtatcttgacaaaccctcctaccttttctcctaactacat

SEQ ID NO: 26824 - DNA, 69 bp, Homo sapiens; identical to SEQ ID NO: 26823

SEQ ID NO: 26825 - DNA, 65 bp, Homo sapiens
cggcggcggcggcggcggcggcggcagtaattgttcctgcctcctccgccacctccgcccctgcc

SEQ ID NO: 26826 - DNA, 70 bp, Homo sapiens
ggtcggcgtcccggctctgtacccagtccgccggaggtgagccgcgtttgctactccgggtcccgattcc

SEQ ID NO: 26827 - DNA, 73 bp, Homo sapiens
tgttcctcaggtcagtctcccaccatttcctcctctctccttgttgcagtgtgaagctgatttggggaacctt

SEQ ID NO: 26828 - DNA, 85 bp, Homo sapiens
caggcggatcccgaaggcctgcgggccgccgccgggccgggccagcccgcagcccggcgcgccagggccggcgggggcccctcgg

SEQ ID NO: 26829 - DNA, 72 bp, Homo sapiens
ctccctttgcttcacttgactgtcttaaaaaaaaaaaaaaaaaaaaaagaacattcatggctgggcccagtg

SEQ ID NO: 26830 - DNA, 53 bp, Homo sapiens
cagcccagtggtgtgtgatcgacacgattgatcatcacacatacactgggcaa

SEQ ID NO: 26831 - DNA, 74 bp, Homo sapiens
aaccatcccagtttccctaggactgttccagtttgagcacaggcagtcctatgtcacaggactgggatggttgg

SEQ ID NO: 26832 - DNA, 55 bp, Homo sapiens
gagcctgggaaggtggccgagcaccccttcttcttgggcccttcccagtgctccc

SEQ ID NO: 26833 - DNA, 69 bp, Homo sapiens
gcgcgcggtggtgtggcagagccagccgaatcgctggctgcagacggctcggcccacccacgcgcccgc

SEQ ID NO: 26834 - DNA, 85 bp, Homo sapiens
aatctaggaggcaggtgctcacttgtcctcctccatgcttggaaaatgcagggaggaggccatagtggcaactgttaccatgatt

SEQ ID NO: 26835 - DNA, 69 bp, Homo sapiens; identical to SEQ ID NO: 19731

SEQ ID NO: 26836 - DNA, 111 bp, Homo sapiens
gccgggaggttgaacatcctgcatagtgctgccaggaaatccctatttcatataagagggggctggctggttgcatatgtaggatgtcccatctcccagcccacttcgtca

SEQ ID NO: 26837 - DNA, 60 bp, Homo sapiens
acaggtattttctaagtgggtctttggatggaaagctccgcctttggaacatacctgaca

SEQ ID NO: 26838 - DNA, 82 bp, Homo sapiens
ggcggcggagccgggaagtggaagagggagcgaaggaggcggggactgccaaggctccagcccggccgggctccgaggcgag

SEQ ID NO: 26839 - DNA, 60 bp, Homo sapiens
ccggagagccccaggcccgagccacgcggtcttccgggcccgggtcggggctcgatggct

SEQ ID NO: 26840 - DNA, 60 bp, Homo sapiens; identical to SEQ ID NO: 26839

SEQ ID NO: 26841 - DNA, 78 bp, Homo sapiens
ataggggccggcggggcacggaccccgctcagcgcacccgcctccgcggttcccacccacgctccccggaccccgtcc

SEQ ID NO: 26842 - DNA, 88 bp, Homo sapiens
gctctctgggagccacggattggagtaacaatttacctaatgtgctcaatttacctaatgtgctattctactgtggctgtggttgcac

SEQ ID NO: 26843 - DNA, 51 bp, Homo sapiens
cggcgggtgcgggggtcggcggcggaaccgcctggcgttcgctcccctccc

SEQ ID NO: 26844 - DNA, 60 bp, Homo sapiens
tgagtttacagatgaggagtaagtaacccttgggccttactcctcatttgtaaactcagg

SEQ ID NO: 26845 - DNA, 54 bp, Homo sapiens
cctaggcaggggtggctggtaagcagctgtgccgatggcctgcctctgcctaca

SEQ ID NO: 26846 - DNA, 59 bp, Homo sapiens
cagagggcggtggtggcgccttcctgccgagtccgaggccgcccccgccacccttctct

SEQ ID NO: 26847 - DNA, 91 bp, Homo sapiens
aaacgatactaaactgtttttgcgatgtgttcctaatatgcactataaatatattgggaacattttgcatgtatagttttgtatcaatata

SEQ ID NO: 26848 - DNA, 97 bp, Homo sapiens
cagatctcagacatctcggggatcatcatgtcacgagataccagtgtgcacttgtgacagattgataactgaaaggtctgggagccactcatcttca

SEQ ID NO: 26849 - DNA, 52 bp, Homo sapiens
gtgggcggggccacgagcggggctccaaccctctcatggactccgcccacaa

SEQ ID NO: 26850 - DNA, 64 bp, Homo sapiens
tcagaacagtggctggcatgcactggctctgagcactctctgcatgccagccactgtactgagt

SEQ ID NO: 26851 - DNA, 63 bp, Homo sapiens
ctgaggcggtgagtccccgagcggccagagggcgtggccgttccctggggcgcgggcgcgggt

SEQ ID NO: 26852 - DNA, 84 bp, Homo sapiens
ggccgcccgcggtcggaccactccccgagggctcacgggaaaggggcggggcccgggggtagccgtcggagcgcgcgccgccgc

SEQ ID NO: 26853 - DNA, 83 bp, Homo sapiens; identical to SEQ ID NO: 19243

SEQ ID NO: 26854 - DNA, 58 bp, Homo sapiens
agccatccttttgaaggacatacacagtaagtgcagtaggcattcagaaggaggcact

SEQ ID NO: 26855 - DNA, 62 bp, Homo sapiens
tccgcgcctccaaacaaagggcgctcggagagtttgagcccttgtgtgtggtggggcggagg

SEQ ID NO: 26856 - DNA, 57 bp, Homo sapiens
tcacctggcggccccgcgttacccacaaggccgcgcgcgcgggggtcggggggcggg

SEQ ID NO: 26857 - DNA, 54 bp, Homo sapiens
aacgcgccgcggggctgttagctcggctgggcacgggcggctccgtggcgcttc

SEQ ID NO: 26858 - DNA, 57 bp, Homo sapiens
gcgccgctccaccgagggccgcgcgtcggccgccgccgggcctgggtgagtgtgcgg

SEQ ID NO: 26859 - DNA, 61 bp, Homo sapiens
tggcccagttcagtacatccccacaaaatgttactagggggatgtactgaactgggtcaga

SEQ ID NO: 26860 - DNA, 72 bp, Homo sapiens
ggaaggcaggagagaggggcgggtggggtggggagtctgtgccttcacctcctccgcccaccctgcttcagg

SEQ ID NO: 26861 - DNA, 54 bp, Homo sapiens
ctctgtgccttccccatggtggagctgggtgccagcatggagcaggcccggaga

SEQ ID NO: 26862 - DNA, 54 bp, Homo sapiens; identical to SEQ ID NO: 26861

SEQ ID NO: 26863 - DNA, 60 bp, Homo sapiens
ctgggtgggcaggtggaccgggtgccgccagcatgcactcaggaaccctgcccgcccccc

SEQ ID NO: 26864 - DNA, 51 bp, Homo sapiens
ggaggtgcgggggggtctgggccagcctccctgaccctgccgtgcctcagg

SEQ ID NO: 26865 - DNA, 57 bp, Homo sapiens
gcctcggatgacggggatgtgcttgattccttccagaccagcccctccaccgagtcc

SEQ ID NO: 26866 - DNA, 80 bp, Homo sapiens
ttcacgatccgctgggacccgcgagccccgccgccgttatgaacatccgcaatgcgagggtgagcgcccggggcgggagg

SEQ ID NO: 26867 - DNA, 65 bp, Homo sapiens
gctgccggggggcgggaggcgcgcgggctcctggcgccgacgcctgacgccccccgccccgcagc

SEQ ID NO: 26868 - DNA, 70 bp, Homo sapiens
ggccgcggcgcgcaagatggcggcgggcccgggcaccgccccttccgccccgccgggcgtcgcacgaggc

SEQ ID NO: 26869 - DNA, 62 bp, Homo sapiens
gggtgggagggcaggtggctggggtgtccctgcgaggtctcagcctccgctcctctccccgc

SEQ ID NO: 26870 - DNA, 57 bp, Homo sapiens
aagggaggggtcgcccagccgagctgctggtgctcagctggcccctctgcctgcagc

SEQ ID NO: 26871 - DNA, 57 bp, Homo sapiens; identical to SEQ ID NO: 26870

SEQ ID NO: 26872 - DNA, 57 bp, Homo sapiens
gggcggggcggggcggggcgcggcgggtggggcggggcgcgcgcggctcccgcgcac

SEQ ID NO: 26873 - DNA, 58 bp, Homo sapiens
ggagtctgggggggccccttacgccattcctgggccccgcggccccgccaggcctcgc

SEQ ID NO: 26874 - DNA, 68 bp, Homo sapiens
accgcggccgtcggggctcgctcgctcagtacctggaggcgagttcctgacgcgactgcgactcaatc

SEQ ID NO: 26875 - DNA, 54 bp, Homo sapiens
acctacagtggactacccgatttttcgcttctcttcagggatgagtcatgtggt

SEQ ID NO: 26876 - DNA, 53 bp, Homo sapiens
tagcttatctctgcagccttgacaatgacccttgatcaaactgtgagaacaac

SEQ ID NO: 26877 - DNA, 57 bp, Homo sapiens
gggacgcagcacggagggcgcgctcagccccgccgccctcccgcctgcgcccctcgg

SEQ ID NO: 26878 - DNA, 57 bp, Homo sapiens; identical to SEQ ID NO: 26877

SEQ ID NO: 26879 - DNA, 63 bp, Homo sapiens
gcctggatcattctgatcaagatggctacagatacataagcattgatcagaagtccagcctaa

SEQ ID NO: 26880 - DNA, 62 bp, Homo sapiens
tgagtgagtggaaactgggagctgtggatccccggcaggctccctccctcactcactcaaca

SEQ ID NO: 26881 - DNA, 60 bp, Homo sapiens
ctcaggactgggtcattctgttcctcgccagtgggagagcagtggggcctggtcccgagc

SEQ ID NO: 26882 - DNA, 63 bp, Homo sapiens
gctagttccaatttatagtgatgactttgtgtgcatgattatcttatactttggactggtctc

SEQ ID NO: 26883 - DNA, 57 bp, Homo sapiens
gtgggaagtatgcagcaagtcaggtttatagagctgcccatactttcacccctctct

SEQ ID NO: 26884 - DNA, 64 bp, Homo sapiens
tccagtgtttctttagtgcctgggcacagagtaggtgccaggcactaaagagacactggagaat

SEQ ID NO: 26885 - DNA, 64 bp, Homo sapiens; identical to SEQ ID NO: 26884

SEQ ID NO: 26886 - DNA, 66 bp, Homo sapiens
tctccagtgtctctttagtgcctggcacctactctgtgcccaggcactaaagaaacactggagaat

SEQ ID NO: 26887 - DNA, 62 bp, Homo sapiens
tgacaacaccccaagaatattctaaaatattctaaaaagaatactcttggggtgttgtcata

SEQ ID NO: 26888 - DNA, 61 bp, Homo sapiens
caggttggggcggctgctcgctcgcgcgcagaacgcggcggtcagctgcgcccggcctgaa

SEQ ID NO: 26889 - DNA, 55 bp, Homo sapiens
tgcccccagactgggctcagtgtccctctgtggcactgagcccctctgtggccga

SEQ ID NO: 26890 - DNA, 53 bp, Homo sapiens
tggatgggatcggagctctagagtctggatctctagaacactctggccccatc

SEQ ID NO: 26891 - DNA, 54 bp, Homo sapiens
gcgttgtcctcgcgccttcgccctgggtaggtgaggccgagaaggcaaccgcga

SEQ ID NO: 26892 - DNA, 58 bp, Homo sapiens
ggcgccctgcgtccctccccacgcgtgacggtgccccgcggggagggaagggcgcccc

SEQ ID NO: 26893 - DNA, 68 bp, Homo sapiens
tggtaggagctatcagaacttagtgatcaagtgaagtcgtagttactaatttctgatgctcttcccct

SEQ ID NO: 26894 - DNA, 59 bp, Homo sapiens
cctgttcgtaaatgttagtggattattacattacattgcactaacgtttatgaacagtc

SEQ ID NO: 26895 - DNA, 54 bp, Homo sapiens
cagacagagagggctaaggtgcctgagtgtggagcccagccctcttctgtctcc

SEQ ID NO: 26896 - DNA, 58 bp, Homo sapiens
gctgggaaggtggtgctgctgagtgcgggttattccattagctccctcttcccatgtt

SEQ ID NO: 26897 - DNA, 60 bp, Homo sapiens
taacttctcattatgccttctggagttatcccatacgctctgggcgtggtgagaagttca

SEQ ID NO: 26898 - DNA, 61 bp, Homo sapiens
tgtgcagtactcaccccctccgtctgctccctccaaggtgtgggggtgggcagtgctcagg

SEQ ID NO: 26899 - DNA, 60 bp, Homo sapiens
gagacttagttctagtcctagtactggtattaaccagctctgagactagagcaaagccct

SEQ ID NO: 26900 - DNA, 56 bp, Homo sapiens
tgcgagcccgaggcgctgcgaacggtgcctaacgtcagacgtctcgaggctcgcgt

SEQ ID NO: 26901 - DNA, 63 bp, Homo sapiens
caaagggtgagaataccagccattcatatcatgagctgtggctggtgttcccaccctttgagc

SEQ ID NO: 26902 - DNA, 63 bp, Homo sapiens; identical to SEQ ID NO: 26901

SEQ ID NO: 26903 - DNA, 61 bp, Homo sapiens
ttaatatgtactgacaaagcgtatctgtgtaataaatatgctttttgtcagtacatgttaa

SEQ ID NO: 26904 - DNA, 65 bp, Homo sapiens
ggatttttatttcattacagtgtgagctgcctggaatacatgtggtaatgaaataaaaaccctgc

SEQ ID NO: 26905 - DNA, 60 bp, Homo sapiens
aaccctttcctatagttgttgctatccttgttgattaagcaacaaatacaggaaagagtt

SEQ ID NO: 26906 - DNA, 59 bp, Homo sapiens
tggctggctgctccgggcactggcaggagcaagctccgtgtccagaatggccagccaga

SEQ ID NO: 26907 - DNA, 59 bp, Homo sapiens; identical to SEQ ID NO: 26906

SEQ ID NO: 26908 - DNA, 62 bp, Homo sapiens
tgacacagagagagagacaggaattatgttcactttctgtctctctctctccgtgtcagtgt

SEQ ID NO: 26909 - DNA, 62 bp, Homo sapiens; identical to SEQ ID NO: 26908

SEQ ID NO: 26910 - DNA, 61 bp, Homo sapiens
aggccattccccatcagatgagtcctagcagtttgggcccatctgatggggaatggcctgc

SEQ ID NO: 26911 - DNA, 66 bp, Homo sapiens
catggtccattttgctctgcttctgaaagctgagtactttgcaagcagagcaaaacggaccatgca

SEQ ID NO: 26912 - DNA, 66 bp, Homo sapiens; identical to SEQ ID NO: 26911

SEQ ID NO: 26913 - DNA, 59 bp, Homo sapiens
tcaggtcttcagactgtggggcttacacgagcagcccccctggtttgcaggccttttga

SEQ ID NO: 26914 - DNA, 61 bp, Homo sapiens
aggtgccattctgagggccaggagtttgattatgtgtcactctggctgctatggccccctc

SEQ ID NO: 26915 - DNA, 79 bp, Homo sapiens
cccgcctcccgctcatccccgctcctgaacgaactttccgcttctagggaagctaggggttggggtgaggaggggggtc

SEQ ID NO: 26916 - DNA, 51 bp, Homo sapiens
aggcccaacatgatccatatccccagggaaatgaatcatgttgggcctgta

SEQ ID NO: 26917 - DNA, 60 bp, Homo sapiens
ctgggtggggtgggggcaggctctcggcccccaatgcctgcccatcccaccccagcatcc

SEQ ID NO: 26918 - DNA, 60 bp, Homo sapiens
gcaggaagagacgcagcagcttgtctttgattctgccaagcttctgcatcttttcttccc

SEQ ID NO: 26919 - DNA, 57 bp, Homo sapiens
aggctccatgaccccggcaggctctggccaaaccttgctgcgtttcatggagcccct

SEQ ID NO: 26920 - DNA, 60 bp, Homo sapiens
atggggcattggaagtggtggtctcccaactaaaaccaccccactatccttgcccctccc

SEQ ID NO: 26921 - DNA, 63 bp, Homo sapiens
ccatatcttaacagctaatctagtaaattctatcttcagaagatttgctgttaagatatggga

SEQ ID NO: 26922 - DNA, 63 bp, Homo sapiens
acaggacctctgtgctttcacctctgtgtccttacacctggagggatgctctgaggtcctgct

SEQ ID NO: 26923 - DNA, 63 bp, Homo sapiens; identical to SEQ ID NO: 26922

SEQ ID NO: 26924 - DNA, 61 bp, Homo sapiens
tccctggacttcttattttggctcttgagctgcctgagcaaaaataggaagtccaaggact

SEQ ID NO: 26925 - DNA, 61 bp, Homo sapiens; identical to SEQ ID NO: 26924

SEQ ID NO: 26926 - DNA, 66 bp, Homo sapiens
tggggtgcaggtgggtgggggcaggtgggaccccagctgaccctgctgatcctctcccaccccaga

SEQ ID NO: 26927 - DNA, 64 bp, Homo sapiens
tgtggtctgaggtcttgggccatcagtgatgtcacaaccagatggcccaagaccccagaccaca

SEQ ID NO: 26928 - DNA, 64 bp, Homo sapiens
tatccgctggcttactctctctcggttgtcctctccgctggggagggagtgaggcgcgggtgcc

SEQ ID NO: 26929 - DNA, 60 bp, Homo sapiens
ggtaaatgaagtaaaatacatgatttagatttacatcatgtattctacttcatttatcca

SEQ ID NO: 26930 - DNA, 56 bp, Homo sapiens
aggctgaattcccagtgagtgccttttgagttgcattcgctgggaattcagcctct

SEQ ID NO: 26931 - DNA, 74 bp, Homo sapiens
aagaagctgggctcagactgctgaagaccaagaagcacaaagaagtcttcagcagtctcagcccagcttccttc

SEQ ID NO: 26932 - DNA, 63 bp, Homo sapiens
cgggacgggagctgcggcgctggctacgagagtgacccagtcagcgttggttcccgtcttggc

SEQ ID NO: 26933 - DNA, 58 bp, Homo sapiens
tgggggcagcattctctgtagatagtttctaattccccagagaaggctgctcctcacc

SEQ ID NO: 26934 - DNA, 64 bp, Homo sapiens
ccaggaatcctgctgtggtggagaggcatagactcatgagtccaccacaatcggatacttgctt

SEQ ID NO: 26935 - DNA, 60 bp, Homo sapiens
gaggaccctgcaggaatggacgtgtgacaaaaaaacagccttttcctgcagcaccccacg

SEQ ID NO: 26936 - DNA, 60 bp, Homo sapiens; identical to SEQ ID NO: 26935

SEQ ID NO: 26937 - DNA, 68 bp, Homo sapiens
tggaggggaaacttggattggggagagggctctgccctcccttcctcattccagggctctcctctacc

SEQ ID NO: 26938 - DNA, 65 bp, Homo sapiens
tctgggaggaaggcagacagagctcatggtctgtggctgctctgccctccttcccctccccaacc

SEQ ID NO: 26939 - DNA, 58 bp, Homo sapiens
tcaggatttaaaggggcactcactcttaaagttgtggagtgcctccttgaaatctgtg

SEQ ID NO: 26940 - DNA, 58 bp, Homo sapiens
aagagttactagaactattcaaccttcagctgtgttgaatagttttagtaactcttga

SEQ ID NO: 26941 - DNA, 64 bp, Homo sapiens
aggaattacctgggaatgggaagttgttttgttttttagcttttcccttttctggtagttctca

SEQ ID NO: 26942 - DNA, 64 bp, Homo sapiens; identical to SEQ ID NO: 26941

SEQ ID NO: 26943 - DNA, 60 bp, Homo sapiens
acagacctggattcaaaaactacctttctatattgggattcttgtttccaggtctggtga

SEQ ID NO: 26944 - DNA, 60 bp, Homo sapiens; identical to SEQ ID NO: 26943

SEQ ID NO: 26945 - DNA, 69 bp, Homo sapiens
agaattaatggctggctgggaggcagagccaagggccactggttcctcccagctggtcattaatcctca

SEQ ID NO: 26946 - DNA, 69 bp, Homo sapiens; identical to SEQ ID NO: 26945

SEQ ID NO: 26947 - DNA, 60 bp, Homo sapiens
tgcacaccttttctcccataccttgccctatgtataggtagggagaagaggtgtggcaat

SEQ ID NO: 26948 - DNA, 58 bp, Homo sapiens
tctggctcctttctaatcactatgtcaggatgccacagtgattagacaggagccagac

SEQ ID NO: 26949 - DNA, 59 bp, Homo sapiens
tttcctctctgccccatagggtgtagctctaactaccctctagggaagagaaggttggg

SEQ ID NO: 26950 - DNA, 59 bp, Homo sapiens; identical to SEQ ID NO: 26949

SEQ ID NO: 26951 - DNA, 68 bp, Homo sapiens
agtgcaaaagtaatcgcagtttttgccattaaaagtaatagcaaaaactgtgattacttttgcaccaa

SEQ ID NO: 26952 - DNA, 53 bp, Homo sapiens
gctctgacgccagtgtcctatgttcatagcataggtcactggggtcagagcca

SEQ ID NO: 26953 - DNA, 60 bp, Homo sapiens
ttgttctcagggccatgcatgatgttcagggtcgtgacttgcgtgaacctgagaatgagc

SEQ ID NO: 26954 - DNA, 57 bp, Homo sapiens
ctctgcttccagtgtgacatcgacaggaatattgatgccatattggaagcaaggcat

SEQ ID NO: 26955 - DNA, 57 bp, Homo sapiens; identical to SEQ ID NO: 26954

SEQ ID NO: 26956 - DNA, 61 bp, Homo sapiens
ccaggctcagggaaactgagacagtggacaagcattgagccccctttccctgagcctgcat

SEQ ID NO: 26957 - DNA, 61 bp, Homo sapiens; identical to SEQ ID NO: 26956

SEQ ID NO: 26958 - DNA, 62 bp, Homo sapiens
aaaaaagtgtgtgtgtgtgtatatatatgtatatatatatacacacacacacactttccaat

SEQ ID NO: 26959 - DNA, 59 bp, Homo sapiens
acaggaagcagtttagtggctgcctggggctgaggcaaccactaaactgcttcctgtct

SEQ ID NO: 26960 - DNA, 64 bp, Homo sapiens
gagtagccactagccacatgtcagttcatgcttttaaggctatatgtgcctagtggctgctgtc

SEQ ID NO: 26961 - DNA, 60 bp, Homo sapiens
tccccccaaaattcataatgttgaagtcctcacctttagcatatgaatttttggggggat

SEQ ID NO: 26962 - DNA, 58 bp, Homo sapiens
tcgttgtaagttgaaaatatagtcaagttgaaaatcttgttttcaacttacaatgggt

SEQ ID NO: 26963 - DNA, 75 bp, Homo sapiens
tgtggaaagagtaggggtcccatttgccatggcatatgcttgcgacatgtgggtcccctactctttccacagtga

SEQ ID NO: 26964 - DNA, 60 bp, Homo sapiens
gcttgttagacatgcagcatcttagacatactgaatcagattctgcaatttaacaagatc

SEQ ID NO: 26965 - DNA, 58 bp, Homo sapiens
tgtccagggccttacctcttcagattctgactcaatctggggtggagccctggagtct

SEQ ID NO: 26966 - DNA, 58 bp, Homo sapiens; identical to SEQ ID NO: 26965

SEQ ID NO: 26967 - DNA, 58 bp, Homo sapiens
aggcctccagacacaccgcagccagttcctgagggcttttgtgtgtcagggtgcaggt

SEQ ID NO: 26968 - DNA, 58 bp, Homo sapiens
tcactctgtctttcctgcctcatggggataagtgatgggcagaagagccagggcgagt

SEQ ID NO: 26969 - DNA, 59 bp, Homo sapiens
tggcttgccggggtaggggctccgctaggggctggagtccgtcccttcgccagcgcaga

SEQ ID NO: 26970 - DNA, 54 bp, Homo sapiens
agaaaggaacactgagctgagtgcatgccctcagctcagtgttcctttttcagt

SEQ ID NO: 26971 - DNA, 54 bp, Homo sapiens; identical to SEQ ID NO: 26970

SEQ ID NO: 26972 - DNA, 58 bp, Homo sapiens
cgccgcccaggcaaggccgccctgccttgggcgcagcgctgccatggctgggggccgt

SEQ ID NO: 26973 - DNA, 58 bp, Homo sapiens
tggattcctctgcctgggagggatgtacatttcacccaagcccaggggagggaccagc

SEQ ID NO: 26974 - DNA, 58 bp, Homo sapiens
gtgtggggagcacgtgaggctgggtcagctatgagctcagccaagtggtccccaccaa

SEQ ID NO: 26975 - DNA, 58 bp, Homo sapiens; identical to SEQ ID NO: 26974

SEQ ID NO: 26976 - DNA, 67 bp, Homo sapiens
aaggcctttcaaaatatgttaaaagataaaatttattatgtctcttaacatattttgaaaggcctga

SEQ ID NO: 26977 - DNA, 71 bp, Homo sapiens
cagggggctccatttgcaactttggatgtggctttggcctctttgtccaaagtgaccttggggcccccaga

SEQ ID NO: 26978 - DNA, 69 bp, Homo sapiens
aacaggctggcgctctaggacgctctgtgttcactgatgatgaagaaacctagaactccaagcctgttt

SEQ ID NO: 26979 - DNA, 61 bp, Homo sapiens
atagtgacctttctggacttgtaggtgtgaacgtatttaaagcccagatttgtgactatgc

SEQ ID NO: 26980 - DNA, 61 bp, Homo sapiens
gctggggtctagcaggcctgagccttttccagggtggccagcctgctggagcttacagtgg

SEQ ID NO: 26981 - DNA, 52 bp, Homo sapiens
cagccgtatcagtgaagagtgaagcactgcactctttaaggatagggctgaa

SEQ ID NO: 26982 - DNA, 52 bp, Homo sapiens; identical to SEQ ID NO: 26981

SEQ ID NO: 26983 - DNA, 65 bp, Homo sapiens; identical to SEQ ID NO: 17542

SEQ ID NO: 26984 - DNA, 62 bp, Homo sapiens
tgtgtgtgtgaatgtgtgcacatgggtatgcaaatgcatgtgtgcactgtacacatacatgt

SEQ ID NO: 26985 - DNA, 62 bp, Homo sapiens
tcccaggcactagcatgaccagctccgaaaaaagagccggagctggtccaatgcctgggaga

SEQ ID NO: 26986 - DNA, 62 bp, Homo sapiens; identical to SEQ ID NO: 26985

SEQ ID NO: 26987 - DNA, 65 bp, Homo sapiens
caggagggaggagttcctgagggctcccttgctcccctgccctcaggcagctgttccctccttgt

SEQ ID NO: 26988 - DNA, 59 bp, Homo sapiens
accctcagtccgtattggtctctatggcatccatagaggccattcggctctgaggtcct

SEQ ID NO: 26989 - DNA, 59 bp, Homo sapiens; identical to SEQ ID NO: 26988

SEQ ID NO: 26990 - DNA, 52 bp, Homo sapiens
gtgggggtgtgggtgagggctgctgctgcaggtctgagccataccccctcct

SEQ ID NO: 26991 - DNA, 60 bp, Homo sapiens
tagtccaggcagactctcctgaagtggagcctgacattcagggggtggggctgggctggc

SEQ ID NO: 26992 - DNA, 60 bp, Homo sapiens
actggagctggcctctgttttatttatttatttaataaaaacaggctctcgctctgtagc

SEQ ID NO: 26993 - DNA, 66 bp, Homo sapiens
cctggcctgttttaaccctgtgcattctggccaatgagaaaccccagggttttgcagaccgggtct

SEQ ID NO: 26994 - DNA, 57 bp, Homo sapiens
gggatgggaagagacccgggacactgccccattgtcccttctcttcccaccaccccc

SEQ ID NO: 26995 - DNA, 58 bp, Homo sapiens
ggtgtcggggtgggagttgcggggatttttcaagaagcagcagctaccccggcgtcgg

SEQ ID NO: 26996 - DNA, 58 bp, Homo sapiens
taactcttagaatccccaaagcattctgtgaagtggtttggggattctaagaggaaga

SEQ ID NO: 26997 - DNA, 58 bp, Homo sapiens; identical to SEQ ID NO: 26996

SEQ ID NO: 26998 - DNA, 62 bp, Homo sapiens
ctgggaggaaagcacaaggtttttccttcccccttgttaaagcctctgtgttttgccctagt

SEQ ID NO: 26999 - DNA, 62 bp, Homo sapiens
agacagtaacagcccgggacagcctttcccaaaataaaggcccctgggctgttactgttccc

SEQ ID NO: 27000 - DNA, 62 bp, Homo sapiens; identical to SEQ ID NO: 26999

SEQ ID NO: 27001 - DNA, 53 bp, Homo sapiens
agagggatctgggcttggaatcctggagggctccaggctcatggtccctcact

SEQ ID NO: 27002 - DNA, 59 bp, Homo sapiens
aagtgccctgtccctgtgtgctgacaggtccctgtgtgcagcatggtcggggcacttct

SEQ ID NO: 27003 - DNA, 61 bp, Homo sapiens
cccgcctcctcgccccccccggcccggggcgctggtgctggggggggccggcggcggcggc

SEQ ID NO: 27004 - DNA, 66 bp, Homo sapiens
gtgcaaaagttgttgcggtttttgccattacttttagtagcaaaaactgcaatgactttcgcacca

SEQ ID NO: 27005 - DNA, 58 bp, Homo sapiens
tgctgggctgcactctcagagttttttattcagtaaatctggagtggagctcaggaac

SEQ ID NO: 27006 - DNA, 55 bp, Homo sapiens
agcacctgccgagcactgagaacaaggaagccctcagtgcacgttagctgtcatt

SEQ ID NO: 27007 - DNA, 55 bp, Homo sapiens; identical to SEQ ID NO: 27006

SEQ ID NO: 27008 - DNA, 61 bp, Homo sapiens
gaagggctggtgctctaggcgcctccgtggcccccgttgcctgggcacctacttcctgcct

SEQ ID NO: 27009 - DNA, 67 bp, Homo sapiens
gcggcctgagccctgaagcgcggcctcccttttctgaccgcttcgcgcttgcggggccaggcacccc

SEQ ID NO: 27010 - DNA, 59 bp, Homo sapiens
ctggaccacttagctccctggcttcagccctttttccagggaggtgaatggttctgtct

SEQ ID NO: 27011 - DNA, 60 bp, Homo sapiens
cgcggtcgcgctgagtcacagcccgctcagagctcagcgtgactcagggctggccgcctc

SEQ ID NO: 27012 - DNA, 60 bp, Homo sapiens
ggtctggccggagagtccgtgcgtaaagcagctacagctctgacctctctgacctgcagc

SEQ ID NO: 27013 - DNA, 62 bp, Homo sapiens
agagtccccatggggtccctcctgcctgtgtctccacaagagggaccccatgggaactctac

SEQ ID NO: 27014 - DNA, 70 bp, Homo sapiens
acacagctctgatgatctctatgtagatgcctatataaatagctatatagatatcatcagagctgtgtat

SEQ ID NO: 27015 - DNA, 60 bp, Homo sapiens
caaaagtaattgtggtttttgttactgaaagtaatggcaaaagccgcaattactttagca

SEQ ID NO: 27016 - DNA, 60 bp, Homo sapiens
agcccgggagggctgtctgggatttctagagggtcccagaacgggttcttcccaggccga

SEQ ID NO: 27017 - DNA, 66 bp, Homo sapiens
ggggtggcggaggtttctgagaagtgacataggctgggatgactcagaaccgaccgcctcccagct

SEQ ID NO: 27018 - DNA, 79 bp, Homo sapiens
ggtcagaagtttggacatagtgtggctgggtcctctgtgcagggtcttacccagccacactacatccaaacttctgacc

SEQ ID NO: 27019 - DNA, 57 bp, Homo sapiens
catctcccgcctccttttcccgccgactgagagggcggggaaagggccgggaagggc

SEQ ID NO: 27020 - DNA, 66 bp, Homo sapiens
tggctgtgccatcccagggaccatggggactggccagctggccctgcacctgacacagcctccagc

SEQ ID NO: 27021 - DNA, 66 bp, Homo sapiens; identical to SEQ ID NO: 27020

SEQ ID NO: 27022 - DNA, 59 bp, Homo sapiens
tggggagaggaggggaccagggctgtgaattaccttcccttccccaccctctcctgcag

SEQ ID NO: 27023 - DNA, 60 bp, Homo sapiens
gtgtgtgcacctgtgtctgtctgtattcgtgttgtatagacagacgcaggtacacacaga

SEQ ID NO: 27024 - DNA, 60 bp, Homo sapiens; identical to SEQ ID NO: 27023

SEQ ID NO: 27025 - DNA, 60 bp, Homo sapiens
tcatgtctgaaccaatgagagcctgagaaatgagctgctctcattggtcaggcctgagtc

SEQ ID NO: 27026 - DNA, 60 bp, Homo sapiens; identical to SEQ ID NO: 27025

SEQ ID NO: 27027 - DNA, 59 bp, Homo sapiens
gcacacatacaaacaaacacacacaaaaaacgggcatgtgtgtttgtgtatgtgtatgt

SEQ ID NO: 27028 - DNA, 57 bp, Homo sapiens
gcaggcctcacttggcaccagtgctgtgtggcctccctggtctaaggagaggcttgg

SEQ ID NO: 27029 - DNA, 55 bp, Homo sapiens
tgaggaggatctgaaggattggactcaggttcgaaacctccacttcctcctcatc

SEQ ID NO: 27030 - DNA, 55 bp, Homo sapiens; identical to SEQ ID NO: 27029

SEQ ID NO: 27031 - DNA, 61 bp, Homo sapiens
ttagtggctccctctgcctgcagaatggaagaccacgtgcaggtgagggtggagccaccga

SEQ ID NO: 27032 - DNA, 77 bp, Homo sapiens
gcgcctgccccgctgggtcctgccccggcgcccggtggcagcgggcggggggcagcgtcccgggcggggactcgcgg

SEQ ID NO: 27033 - DNA, 61 bp, Homo sapiens
gtccccagactctcccgggctgtggcgaataactgtaaagcggggagaggtctggggaaag

SEQ ID NO: 27034 - DNA, 60 bp, Homo sapiens
gccgcggcgagggcgggggaagaaaaacaccctgtttcctctccggcccccaccgcggat

SEQ ID NO: 27035 - DNA, 51 bp, Homo sapiens
gattccaaggccagaggaaaggcccacccttttctctggccttggaatcct

SEQ ID NO: 27036 - DNA, 64 bp, Homo sapiens
taggccattttggaagctgttttattaataattgattttcttacaacttacaacatggcctttt

SEQ ID NO: 27037 - DNA, 64 bp, Homo sapiens; identical to SEQ ID NO: 27036

SEQ ID NO: 27038 - DNA, 52 bp, Homo sapiens
ttgagccgtggccgcctgcccggggcgcggggaggtcggctgcggctccgct

SEQ ID NO: 27039 - DNA, 58 bp, Homo sapiens
ttcgggtttagaggtttctgttgctcccagggcagcaacagagacctctaaacccaaa

SEQ ID NO: 27040 - DNA, 58 bp, Homo sapiens; identical to SEQ ID NO: 27039

SEQ ID NO: 27041 - DNA, 57 bp, Homo sapiens
ctggaattctgtatctgagcagctctctcctgtctgctcagatatagaactccagag

SEQ ID NO: 27042 - DNA, 70 bp, Homo sapiens
ttatcctgtaaatcagccttatcagtttgttactcatggtcaaactgataaggctgatttacaggagaga

SEQ ID NO: 27043 - DNA, 54 bp, Homo sapiens
aggtgacaatgtcaggtgctcaggtgctcaggagctcctgacattgtcacctga

SEQ ID NO: 27044 - DNA, 62 bp, Homo sapiens
tggggcctggcccctgagatgtgtaggttatacatcatacaactcaggggccaggcaccatt

SEQ ID NO: 27045 - DNA, 61 bp, Homo sapiens
ttgtgtccagttgttgggggagatgtgtaagcttggctccctcagccactgctgacaccag

SEQ ID NO: 27046 - DNA, 60 bp, Homo sapiens
attcagctacgatcaccagggcatatcatagctgaaaggccctggtgatggtagctgaat

SEQ ID NO: 27047 - DNA, 60 bp, Homo sapiens
acgaactcataagataatacctgcgatgaggcattcaggtgttaccttatgggtttgtga

SEQ ID NO: 27048 - DNA, 53 bp, Homo sapiens
tcctttcagatggttctctagagaaccatctctagagaaccatctgaaagact

SEQ ID NO: 27049 - DNA, 53 bp, Homo sapiens; identical to SEQ ID NO: 27048

SEQ ID NO: 27050 - DNA, 57 bp, Homo sapiens
tacaacagatgagacatacctaaatcattgctagcttaggtgtgtctgatctgttgt

SEQ ID NO: 27051 - DNA, 58 bp, Homo sapiens
gtctctgcatttggggtatgtgtgggttctaaacacatacccccccaatgcagagaca

SEQ ID NO: 27052 - DNA, 58 bp, Homo sapiens
agaagtaattgcggtctttgccattgcttttaaaaggcaaaaaccacaattacttttg

SEQ ID NO: 27053 - DNA, 60 bp, Homo sapiens
tggcccaagaatagctggccagtggccttgcttttggctggccactcttgggaaagctgg

SEQ ID NO: 27054 - DNA, 57 bp, Homo sapiens
tttgattggccagtggacagcgccgtggcatgacgcgctggggcgctggccaatcgg

SEQ ID NO: 27055 - DNA, 60 bp, Homo sapiens
ttgggcatatgtgtatatatgtgtatgtgtatatatgtgtatgtacacatatgcctaaca

SEQ ID NO: 27056 - DNA, 59 bp, Homo sapiens
atggacacataagaggtactaatgaaaggttattagaatctcttatgggtccatagaac

SEQ ID NO: 27057 - DNA, 57 bp, Homo sapiens
tcaggatcaggatctgcagagttattagtatagtgctctgcagatcctggtcctagt

SEQ ID NO: 27058 - DNA, 57 bp, Homo sapiens
gcctcagaaatataaaactagctggttgatcccggctagttttatatttttgagccc

SEQ ID NO: 27059 - DNA, 62 bp, Homo sapiens
tggtccaacgacaggagtaggcttgtatttaaaagcggcccctcctctcctgtggccacaga

SEQ ID NO: 27060 - DNA, 62 bp, Homo sapiens; identical to SEQ ID NO: 27059

SEQ ID NO: 27061 - DNA, 64 bp, Homo sapiens
atctccccagttatgacaaccaaaaaatgcctctaatttttggttgtcacaactgggggaatgg

SEQ ID NO: 27062 - DNA, 65 bp, Homo sapiens
tgtgggcgacaaggtttgctgctgagaacagtttgaaaaccagcaaagcaggtggcccagggccc

SEQ ID NO: 27063 - DNA, 58 bp, Homo sapiens
ggctccaccttcctaggttggctttgctctcatgccagctttgcaggtggtgactaga

SEQ ID NO: 27064 - DNA, 58 bp, Homo sapiens; identical to SEQ ID NO: 27063

SEQ ID NO: 27065 - DNA, 58 bp, Homo sapiens
gctgtgttaattctcttctgtataaacaagagagtacagaagacagttaacataacaa

SEQ ID NO: 27066 - DNA, 82 bp, Homo sapiens
tccccacctggaatttctatgatatctatatctataaacctatatagatttatagatatcatagaaattccaggtaggagta

SEQ ID NO: 27067 - DNA, 62 bp, Homo sapiens
ttgggcaggtcccaggcattcctcatctgttagaggccagcaatgcccaggtctgccctaga

SEQ ID NO: 27068 - DNA, 61 bp, Homo sapiens
tccatagagtggactgtctgtgctgtggactccataaagcagactgtctgtgctgtggact

SEQ ID NO: 27069 - DNA, 58 bp, Homo sapiens
ccggctcccgaggacaccggctgcgtgcacttggccgcgtgttcctggggagccgaag

SEQ ID NO: 27070 - DNA, 60 bp, Homo sapiens
cctctccccgcttttaaccctactgccatgatgcagtagggttaagagtggggagaagat

SEQ ID NO: 27071 - DNA, 60 bp, Homo sapiens
cttctccccactcttaaccctactgcatcatggcagtagggttaaaagcggggagagggt

SEQ ID NO: 27072 - DNA, 69 bp, Homo sapiens
gtgggcagagcagagcctgcattggccatctccatctggcccaggccaacaggccttgctctgctcaca

SEQ ID NO: 27073 - DNA, 61 bp, Homo sapiens
cacaggcaggagaccccacagccagctatgccctgagcctgtggtggctgctgctggtgcc

SEQ ID NO: 27074 - DNA, 54 bp, Homo sapiens
agttccaaaatgtcaatttgattttaaaggatcaaattgacatttgggaactga

SEQ ID NO: 27075 - DNA, 62 bp, Homo sapiens
tcagggatgctacttaacttctctatatttgttcctgtgagaagttaagtaggatccctgat

SEQ ID NO: 27076 - DNA, 58 bp, Homo sapiens
tgaaagtaattgcggttttgccattatttttgaaggcaaaaatcacaattattttcgc

SEQ ID NO: 27077 - DNA, 58 bp, Homo sapiens; identical to SEQ ID NO: 27076

SEQ ID NO: 27078 - DNA, 64 bp, Homo sapiens
aaacaaatgtatctatgtgtatgtatgtgtgtatctgctatactatgtagatatatttgttttt

SEQ ID NO: 27079 - DNA, 66 bp, Homo sapiens
tgccctgagacttttgctctaataatttattctaataataatttagatcaaaagcctcagggcaga

SEQ ID NO: 27080 - DNA, 59 bp, Homo sapiens
agaaggagctgggctgatctgagcaggtaggagctctgcatcaggccactccttcctcc

SEQ ID NO: 27081 - DNA, 56 bp, Homo sapiens
gaattctggaaagtgtgagtttggagttgcccaaactgacacttctcagaattctt

SEQ ID NO: 27082 - DNA, 60 bp, Homo sapiens
gcaaaagtaatggcggttttgccattaaaagcaatggcaaaaccgccattacttttgcaa

SEQ ID NO: 27083 - DNA, 52 bp, Homo sapiens
cgagttataattccaaagtcacgatgctggtcactttggcattataactcag

SEQ ID NO: 27084 - DNA, 56 bp, Homo sapiens
gaagagtaattgtggttttgccgttaaagtaatgcgaaaaccgcaattacttctgc

SEQ ID NO: 27085 - DNA, 61 bp, Homo sapiens
agcactgcttttccccatgtggcgcgtgcacacgctcacacagagggacagacagtgcggc

SEQ ID NO: 27086 - DNA, 68 bp, Homo sapiens
cgtcaggctggagggagctggtccctgcgctccctgcgccctggggatgcccctgccgccctgacgcc

SEQ ID NO: 27087 - DNA, 68 bp, Homo sapiens; identical to SEQ ID NO: 27086

SEQ ID NO: 27088 - DNA, 55 bp, Homo sapiens
ttcggtgcagccgtcggaaccttattatttatgaaaggggacagctcacaggatt

SEQ ID NO: 27089 - DNA, 59 bp, Homo sapiens
tctggtgtatagcgttgctcaagtcctctatttctttgaacaacagtatacaccaaata

SEQ ID NO: 27090 - DNA, 62 bp, Homo sapiens
gagctagggatatctcctgagaatgtctcctccctattctcaggaaaaatccctagcttggt

SEQ ID NO: 27091 - DNA, 62 bp, Homo sapiens
agatggggagaactcaatcctaaatgtatttaggaatttaagattgagttctccccatctcc

SEQ ID NO: 27092 - DNA, 62 bp, Homo sapiens; identical to SEQ ID NO: 27091

SEQ ID NO: 27093 - DNA, 56 bp, Homo sapiens
aaactgcatgcctgcacaccaggcatgcagtgatgtgcaggcatgcagtttatgtt

SEQ ID NO: 27094 - DNA, 63 bp, Homo sapiens
ccctggtgacctgtgacaaaggagtgttcagattacatccctcctctgtcccaggcccagact

SEQ ID NO: 27095 - DNA, 60 bp, Homo sapiens
aagtgactgtggtttttgccatttttttttaaagctatggcaaaaactgcaattactttt

SEQ ID NO: 27096 - DNA, 93 bp, Homo sapiens
ctaaaactggatcaattataggagtgaaataaaggtccatctcctgcctatttattactttgctttggtaataaatctatttttaaaagaacc

SEQ ID NO: 27097 - DNA, 62 bp, Homo sapiens
gaaacttctggccccataggatgtaaatgggctttcaaatcctacgtgaccagaagtttcag

SEQ ID NO: 27098 - DNA, 59 bp, Homo sapiens
tgtgccctgagactgctaagtatttgtattcccaatgcctagcagtctcaggacacaca

SEQ ID NO: 27099 - DNA, 59 bp, Homo sapiens; identical to SEQ ID NO: 27098

SEQ ID NO: 27100 - DNA, 60 bp, Homo sapiens
aaagggggtgagctggggagaggaggcgagaggctctccttccccgcttcccccctaggg

SEQ ID NO: 27101 - DNA, 61 bp, Homo sapiens
gccttcttcacatcattcatgccctctttgagctgaggcatgaatgatgtaaatgaggcag

SEQ ID NO: 27102 - DNA, 58 bp, Homo sapiens
ctggcacaaaagtagttgcgggggtctgccataccgcaactatttttgcaccaaacta

SEQ ID NO: 27103 - DNA, 62 bp, Homo sapiens
tctgccattgacccattattgatttcttgggagagatcaataatgggccaatggcagagaga

SEQ ID NO: 27104 - DNA, 62 bp, Homo sapiens
gttgtcagtcaggggtccctggcttgcaaagtgacattgcagggacccctggctggcaatgc

SEQ ID NO: 27105 - DNA, 62 bp, Homo sapiens
attgttcaagtcccacttatgagtgcacatgttctcacttctaaatgggagttgagcaatga

SEQ ID NO: 27106 - DNA, 63 bp, Homo sapiens
caaaggtacttgcagtttttgctatcgaaggtaatggcaaaaaccgcaattacctttgcacca

SEQ ID NO: 27107 - DNA, 58 bp, Homo sapiens
ccacgtccccgcccgccgctgacctgccgcgggggtagggagcgggcgggcgggagcg

SEQ ID NO: 27108 - DNA, 55 bp, Homo sapiens
ccccctggccccgtcgccccgccctcgccgggctgggctgcggggtcaggggccg

SEQ ID NO: 27109 - DNA, 62 bp, Homo sapiens
tgaacttgacttacagggtgaaaatggcttttctctccctcactctgtaagccaagttcatg

SEQ ID NO: 27110 - DNA, 56 bp, Homo sapiens
tagcaagggctccggaaggtcatccttgggccggatgaccttccagagtccttgcc

SEQ ID NO: 27111 - DNA, 57 bp, Homo sapiens
ggcctttgcccgtcattctgggccgagcttggcccagaacgacgggcagaggcgcga

SEQ ID NO: 27112 - DNA, 61 bp, Homo sapiens
ttccccaaaccttgtctggacatggacttgcatggtccatgtctagacaaggctggggaaa

SEQ ID NO: 27113 - DNA, 63 bp, Homo sapiens
ggtgctctgagcccttttgtatccgccctctgctgccagcttcaaaagggctcagagcacagc

SEQ ID NO: 27114 - DNA, 57 bp, Homo sapiens
gagggtctgactgtcacttggagctaaaccagtctccaagtggccatcagaccctct

SEQ ID NO: 27115 - DNA, 66 bp, Homo sapiens
accagctctcatccccagcgctggtaccacacttaggctgggctggggaggtgaactggtgaaggg

SEQ ID NO: 27116 - DNA, 66 bp, Homo sapiens; identical to SEQ ID NO: 27115

SEQ ID NO: 27117 - DNA, 58 bp, Homo sapiens
gtggggtgagatgcagaggcctggcctgttaacgggtccacctgtttctccacccaca

SEQ ID NO: 27118 - DNA, 81 bp, Homo sapiens
tgagggaacagaggactgaagaagtcacaggagttggccatgacttaagctatgacttcttcaggcctctgttcccttgtc

SEQ ID NO: 27119 - DNA, 56 bp, Homo sapiens
aaggtaattgcggttttttccattgaaagtaatggcaaaaaccttaattacctttg

SEQ ID NO: 27120 - DNA, 68 bp, Homo sapiens
ggaaatgttctagccaaaaaagtttgccaagaaccattgtgtctttttttttgctggaacatttctgg

SEQ ID NO: 27121 - DNA, 60 bp, Homo sapiens
tggctcccttctctccgtctgcctcctggccgcggggcccggagagctgggagccagagg

SEQ ID NO: 27122 - DNA, 60 bp, Homo sapiens; identical to SEQ ID NO: 27121

SEQ ID NO: 27123 - DNA, 57 bp, Homo sapiens
aaaagtaattgcggtttttgctattagtttcaatggtaaaaaccgtgactacttctg

SEQ ID NO: 27124 - DNA, 63 bp, Homo sapiens
attgagcaagtgaagtatgtggtagcagtgaagtatctaccacatacttcacttgctcagtgc

SEQ ID NO: 27125 - DNA, 63 bp, Homo sapiens; identical to SEQ ID NO: 27124

SEQ ID NO: 27126 - DNA, 65 bp, Homo sapiens
gctccattataatcttataggaccacatatacagcggtggtgctataggattataatgaagctga

SEQ ID NO: 27127 - DNA, 56 bp, Homo sapiens
ggcgcagagtccgcccgcggccaggtgaggctgggctgagcgggctcgggcgccgc

SEQ ID NO: 27128 - DNA, 62 bp, Homo sapiens
tgggacaaacctcccccagcatgggaactatgggaaccatgctggaggaggtttgtcccaca

SEQ ID NO: 27129 - DNA, 62 bp, Homo sapiens; identical to SEQ ID NO: 27128

SEQ ID NO: 27130 - DNA, 52 bp, Homo sapiens
gtgtgaccctcgcctgggcttgttacagaggcaggttccacaacccagccgt

SEQ ID NO: 27131 - DNA, 60 bp, Homo sapiens
tgagccaccactcccagtcctataaaattttaaaaaaatgtctgggtgtggtggcgcatg

SEQ ID NO: 27132 - DNA, 59 bp, Homo sapiens
atcgcctcgtttcggccactgccaaggccggcggggctcgagacccggcgaggcggtgg

SEQ ID NO: 27133 - DNA, 65 bp, Homo sapiens
gaccgtaaggatacaatgattgagatgcaatgtaagtgctgcaatcatttatgcttgcggaggac

SEQ ID NO: 27134 - DNA, 60 bp, Homo sapiens
gacagacagatcttttcccaaccctttattttgggggttgggaaaagatctgtcatgcaa

SEQ ID NO: 27135 - DNA, 57 bp, Homo sapiens
tggattgtgggttggccacatgggcatattgagcttgcgtgactgaccacaatccga

SEQ ID NO: 27136 - DNA, 57 bp, Homo sapiens; identical to SEQ ID NO: 27135

SEQ ID NO: 27137 - DNA, 67 bp, Homo sapiens
accaacttctccctttcccagaagggtcacttctttttcacttgctgggaaagggagaagttcatgg

SEQ ID NO: 27138 - DNA, 67 bp, Homo sapiens; identical to SEQ ID NO: 27137

SEQ ID NO: 27139 - DNA, 53 bp, Homo sapiens
tctggtaatgcgggtggatgaagttcaccctcatccacccacattaccaagga

SEQ ID NO: 27140 - DNA, 59 bp, Homo sapiens
gccatctcctctgttctttgctgtacacgtggctggcaaagagaagcgaagatggagcc

SEQ ID NO: 27141 - DNA, 59 bp, Homo sapiens; identical to SEQ ID NO: 27140

SEQ ID NO: 27142 - DNA, 63 bp, Homo sapiens
ctgtctgttgtgggtgagctgttgcagcatagacttcacattggctaacccaaaacagagact

SEQ ID NO: 27143 - DNA, 64 bp, Homo sapiens
tgctgaattctgttgatattatttctgctgttttattattttaatatctgctgaattctgctga

SEQ ID NO: 27144 - DNA, 64 bp, Homo sapiens; identical to SEQ ID NO: 27143

SEQ ID NO: 27145 - DNA, 57 bp, Homo sapiens
cgtaacattccacaggctgctagcagctatagatggctgcctgtggcatgttacaga

SEQ ID NO: 27146 - DNA, 57 bp, Homo sapiens
gggctgcggccgcctccccgccctgttgcaccgcgaggaggccgcgccgcagccact

SEQ ID NO: 27147 - DNA, 61 bp, Homo sapiens
cccagcctactggaggataagaggatataaaggtctcttatcctccagtagactagggagc

SEQ ID NO: 27148 - DNA, 61 bp, Homo sapiens; identical to SEQ ID NO: 27147

SEQ ID NO: 27149 - DNA, 58 bp, Homo sapiens
gctgccaccttggcggaaccgcaggccacagcgtggttccgtgtgggccggcagtggc

SEQ ID NO: 27150 - DNA, 52 bp, Homo sapiens
tggagcacaccagtgaaaggttaagttcaccctttcactgatgtgctccact

SEQ ID NO: 27151 - DNA, 58 bp, Homo sapiens
aaaagtagttgtggtttttgccattactttcaaaggcataaaccacaattacttttgc

SEQ ID NO: 27152 - DNA, 59 bp, Homo sapiens
gatgctctctacataaacctaacctaaaattatttttaggtttatgtagagagcgtcta

SEQ ID NO: 27153 - DNA, 60 bp, Homo sapiens
tctgacttcctccttttcaggtctctgacatcttctagagatggaggtggaagtcagaga

SEQ ID NO: 27154 - DNA, 58 bp, Homo sapiens
agtaattgcggtttttgacattgaaattgaaagtaatggccaaaacagcagttacttt

SEQ ID NO: 27155 - DNA, 61 bp, Homo sapiens
tgtgttgctctgtggttctcggcatgtggtcctgatgccaagaaccacagagcaacacaga

SEQ ID NO: 27156 - DNA, 61 bp, Homo sapiens
tgcccccacccacactggaggaaaagtctttaggagactccagttggggtggaggttcaga

SEQ ID NO: 27157 - DNA, 62 bp, Homo sapiens
acaggatgccagcacccaagggcactgacttccatccagcccaggtgtcttccattctgtcc

SEQ ID NO: 27158 - DNA, 62 bp, Homo sapiens; identical to SEQ ID NO: 27157

SEQ ID NO: 27159 - DNA, 64 bp, Homo sapiens
tggagaaaggacttcagggagtcctatattaagtatttggagtccctgaggtcctttctccatt

SEQ ID NO: 27160 - DNA, 63 bp, Homo sapiens
tggggaggccagggaaggggctgtgagcaacgaggttccagcatcttcccaagcctcctccat

SEQ ID NO: 27161 - DNA, 54 bp, Homo sapiens
agcctgcactggcttggtggcttggtgacccgccagcagggtggtgctgtctgt

SEQ ID NO: 27162 - DNA, 59 bp, Homo sapiens
tctgtcagcctcattggtagcaactacctcatgggtgctaccagtgaggctgacagatg

SEQ ID NO: 27163 - DNA, 61 bp, Homo sapiens
acagtaggcacagaatcccactgccattttttataatagtgggattctgtgcctattgtag

SEQ ID NO: 27164 - DNA, 57 bp, Homo sapiens
agattgctctttgactaattaggaatgtgaccttcttaattagccaaggaacaatct

SEQ ID NO: 27165 - DNA, 59 bp, Homo sapiens
tagctgtgcaccctctggcaagttacattacctcttggtgcctcaggttcctcagctag

SEQ ID NO: 27166 - DNA, 58 bp, Homo sapiens
gtctctcctctctagcccccctgtattaggtgttcatgaggctcgccaggggagttga

SEQ ID NO: 27167 - DNA, 52 bp, Homo sapiens
ctgcggccagcgcccgggcctgcgggcccgggcggcggctgtgttgcgcagt

SEQ ID NO: 27168 - DNA, 71 bp, Homo sapiens
tggctcaaaagtaactgcggtttttgctgttactttcaatggcaaaaacctcaattacttttgtgcctatc

SEQ ID NO: 27169 - DNA, 23 bp, Homo sapiens
tctagccacagatgcagtgattg

SEQ ID NO: 27170 - DNA, 24 bp, Homo sapiens
ctctagccacagatgcagtgattg

SEQ ID NO: 27171 - DNA, 25 bp, Homo sapiens
actctagccacagatgcagtgattg

SEQ ID NO: 27172 - DNA, 22 bp, Homo sapiens
tctagccacagatgcagtgatt

SEQ ID NO: 27173 - DNA, 23 bp, Homo sapiens
ctctagccacagatgcagtgatt

SEQ ID NO: 27174 - DNA, 21 bp, Homo sapiens
tctagccacagatgcagtgat

SEQ ID NO: 27175 - DNA, 20 bp, Homo sapiens
tctagccacagatgcagtga

SEQ ID NO: 27176 - DNA, 21 bp, Homo sapiens
ctctagccacagatgcagtga

SEQ ID NO: 27177 - DNA, 20 bp, Homo sapiens
ctctagccacagatgcagtg

SEQ ID NO: 27178 - DNA, 25 bp, Homo sapiens
tgctggatcagtggttcgagtctga

SEQ ID NO: 27179 - DNA, 24 bp, Homo sapiens
tgctggatcagtggttcgagtctg

SEQ ID NO: 27180 - DNA, 23 bp, Homo sapiens
tgctggatcagtggttcgagtct

SEQ ID NO: 27181 - DNA, 21 bp, Homo sapiens
tgctggatcagtggttcgagt

SEQ ID NO: 27182 - DNA, 20 bp, Homo sapiens
tgctggatcagtggttcgag

SEQ ID NO: 27183 - DNA, 19 bp, Homo sapiens
tgctggatcagtggttcga

SEQ ID NO: 27184 - DNA, 17 bp, Homo sapiens
tgctggatcagtggttc

SEQ ID NO: 27185 - DNA, 24 bp, Homo sapiens
tctcccttcctgccctggctaggc

SEQ ID NO: 27186 - DNA, 23 bp, Homo sapiens
tctcccttcctgccctggctagg

SEQ ID NO: 27187 - DNA, 23 bp, Homo sapiens
ctctcccttcctgccctggctag

SEQ ID NO: 27188 - DNA, 21 bp, Homo sapiens
tctcccttcctgccctggcta

SEQ ID NO: 27189 - DNA, 20 bp, Homo sapiens
tctcccttcctgccctggct

SEQ ID NO: 27190 - DNA, 23 bp, Homo sapiens
tggagtggggcaaggttgttggt

SEQ ID NO: 27191 - DNA, 27 bp, Homo sapiens
cccagggcttggagtggggcaaggttg

SEQ ID NO: 27192 - DNA, 23 bp, Homo sapiens
cagggcttggagtggggcaaggt

SEQ ID NO: 27193 - DNA, 28 bp, Homo sapiens
tagcccagggcttggagtggggcaaggt

SEQ ID NO: 27194 - DNA, 23 bp, Homo sapiens
ccagggcttggagtggggcaagg

SEQ ID NO: 27195 - DNA, 24 bp, Homo sapiens
cccagggcttggagtggggcaagg

SEQ ID NO: 27196 - DNA, 25 bp, Homo sapiens
gcccagggcttggagtggggcaagg

SEQ ID NO: 27197 - DNA, 27 bp, Homo sapiens
tagcccagggcttggagtggggcaagg

SEQ ID NO: 27198 - DNA, 23 bp, Homo sapiens
cccagggcttggagtggggcaag

SEQ ID NO: 27199 - DNA, 21 bp, Homo sapiens
cccagggcttggagtggggca

SEQ ID NO: 27200 - DNA, 20 bp, Homo sapiens
cccagggcttggagtggggc

SEQ ID NO: 27201 - DNA, 22 bp, Homo sapiens
tagcccagggcttggagtgggg

SEQ ID NO: 27202 - DNA, 20 bp, Homo sapiens
tagcccagggcttggagtgg

SEQ ID NO: 27203 - DNA, 22 bp, Homo sapiens
actagcccagggcttggagtgg

SEQ ID NO: 27204 - DNA, 23 bp, Homo sapiens
aaagtccttcctatttttccctc

SEQ ID NO: 27205 - DNA, 24 bp, Homo sapiens
caaagtccttcctatttttccctc

SEQ ID NO: 27206 - DNA, 23 bp, Homo sapiens
caaagtccttcctatttttccct

SEQ ID NO: 27207 - DNA, 21 bp, Homo sapiens
caaagtccttcctatttttcc

SEQ ID NO: 27208 - DNA, 22 bp, Homo sapiens
gcaaagtccttcctatttttcc

SEQ ID NO: 27209 - DNA, 20 bp, Homo sapiens
caaagtccttcctatttttc

SEQ ID NO: 27210 - DNA, 21 bp, Homo sapiens
gcaaagtccttcctatttttc

SEQ ID NO: 27211 - DNA, 22 bp, Homo sapiens
atgcaaagtccttcctattttt

SEQ ID NO: 27212 - DNA, 24 bp, Homo sapiens
gaataggagggactttgtattgtg

SEQ ID NO: 27213 - DNA, 25 bp, Homo sapiens
agaataggagggactttgtattgtg

SEQ ID NO: 27214 - DNA, 23 bp, Homo sapiens
gaataggagggactttgtattgt

SEQ ID NO: 27215 - DNA, 22 bp, Homo sapiens
gaataggagggactttgtattg

SEQ ID NO: 27216 - DNA, 23 bp, Homo sapiens
agaataggagggactttgtattg

SEQ ID NO: 27217 - DNA, 21 bp, Homo sapiens
gaataggagggactttgtatt

SEQ ID NO: 27218 - DNA, 22 bp, Homo sapiens
agaataggagggactttgtatt

SEQ ID NO: 27219 - DNA, 24 bp, Homo sapiens
gaagaataggagggactttgtatt

SEQ ID NO: 27220 - DNA, 20 bp, Homo sapiens
gaataggagggactttgtat

SEQ ID NO: 27221 - DNA, 21 bp, Homo sapiens
agaataggagggactttgtat

SEQ ID NO: 27222 - DNA, 22 bp, Homo sapiens
aagaataggagggactttgtat

SEQ ID NO: 27223 - DNA, 23 bp, Homo sapiens
gaagaataggagggactttgtat

SEQ ID NO: 27224 - DNA, 20 bp, Homo sapiens
agaataggagggactttgta

SEQ ID NO: 27225 - DNA, 21 bp, Homo sapiens
aagaataggagggactttgta

SEQ ID NO: 27226 - DNA, 20 bp, Homo sapiens
aagaataggagggactttgt

SEQ ID NO: 27227 - DNA, 20 bp, Homo sapiens
gaagaataggagggactttg

SEQ ID NO: 27228 - DNA, 18 bp, Homo sapiens
aagaataggagggacttt

SEQ ID NO: 27229 - DNA, 22 bp, Homo sapiens
ggtggtgttgggacagctccgt

SEQ ID NO: 27230 - DNA, 17 bp, Homo sapiens
gtgttgggacagctccg

SEQ ID NO: 27231 - DNA, 18 bp, Homo sapiens
gtgttgggacagctccgt

SEQ ID NO: 27232 - DNA, 28 bp, Homo sapiens
cagaagggcttcctctctgcaggaccgg

SEQ ID NO: 27233 - DNA, 21 bp, Homo sapiens
gtcctgcagagaggaagccct

SEQ ID NO: 27234 - DNA, 24 bp, Homo sapiens
agaagggcttcctctctgcaggac

SEQ ID NO: 27235 - DNA, 24 bp, Homo sapiens
gtcctgcagagaggaagcccttct

SEQ ID NO: 27236 - DNA, 25 bp, Homo sapiens
cagaagggcttcctctctgcaggac

SEQ ID NO: 27237 - DNA, 25 bp, Homo sapiens
gtcctgcagagaggaagcccttctg

SEQ ID NO: 27238 - DNA, 23 bp, Homo sapiens
tcctgcagagaggaagcccttct

SEQ ID NO: 27239 - DNA, 22 bp, Homo sapiens
agaagggcttcctctctgcagg

SEQ ID NO: 27240 - DNA, 22 bp, Homo sapiens
cctgcagagaggaagcccttct

SEQ ID NO: 27241 - DNA, 24 bp, Homo sapiens
cctgcagagaggaagcccttctgc

SEQ ID NO: 27242 - DNA, 25 bp, Homo sapiens
cctgcagagaggaagcccttctgct

SEQ ID NO: 27243 - DNA, 22 bp, Homo sapiens
ctgcagagaggaagcccttctg

SEQ ID NO: 27244 - DNA, 26 bp, Homo sapiens
cctgcagagaggaagcccttccaata

SEQ ID NO: 27245 - DNA, 22 bp, Homo sapiens
attggaagggcttcctctctgc

SEQ ID NO: 27246 - DNA, 24 bp, Homo sapiens
cctgcagagaggaagcccttccaa

SEQ ID NO: 27247 - DNA, 28 bp, Homo sapiens
cggtcctgcagagaggaagcccttccaa

SEQ ID NO: 27248 - DNA, 23 bp, Homo sapiens
cctgcagagaggaagcccttcca

SEQ ID NO: 27249 - DNA, 24 bp, Homo sapiens
tcctgcagagaggaagcccttcca

SEQ ID NO: 27250 - DNA, 25 bp, Homo sapiens
gtcctgcagagaggaagcccttcca

SEQ ID NO: 27251 - DNA, 22 bp, Homo sapiens
cctgcagagaggaagcccttcc

SEQ ID NO: 27252 - DNA, 23 bp, Homo sapiens
tcctgcagagaggaagcccttcc

SEQ ID NO: 27253 - DNA, 24 bp, Homo sapiens
gtcctgcagagaggaagcccttcc

SEQ ID NO: 27254 - DNA, 22 bp, Homo sapiens
tcctgcagagaggaagcccttc

SEQ ID NO: 27255 - DNA, 22 bp, Homo sapiens
cggtcctgcagagaggaagccc

SEQ ID NO: 27256 - DNA, 18 bp, Homo sapiens
tgagaactgaattccata

SEQ ID NO: 27257 - DNA, 19 bp, Homo sapiens
tgagaactgaattccatag

SEQ ID NO: 27258 - DNA, 20 bp, Homo sapiens
tgagaactgaattccatagg

SEQ ID NO: 27259 - DNA, 21 bp, Homo sapiens
tgagaactgaattccataggc

SEQ ID NO: 27260 - DNA, 23 bp, Homo sapiens
tgagaactgaattccataggctg

SEQ ID NO: 27261 - DNA, 24 bp, Homo sapiens
tgagaactgaattccataggctgt

SEQ ID NO: 27262 - DNA, 23 bp, Homo sapiens
gagaactgaattccataggctgt

SEQ ID NO: 27263 - DNA, 18 bp, Homo sapiens
aactgaattccataggct

SEQ ID NO: 27264 - DNA, 19 bp, Homo sapiens
tgccctgtggactcagttc

SEQ ID NO: 27265 - DNA, 20 bp, Homo sapiens
tgccctgtggactcagttct

SEQ ID NO: 27266 - DNA, 21 bp, Homo sapiens
tgccctgtggactcagttctg

SEQ ID NO: 27267 - DNA, 23 bp, Homo sapiens
tgccctgtggactcagttctggt

SEQ ID NO: 27268 - DNA, 24 bp, Homo sapiens
tgccctgtggactcagttctggtg

SEQ ID NO: 27269 - DNA, 25 bp, Homo sapiens
tgccctgtggactcagttctggtgc

SEQ ID NO: 27270 - DNA, 26 bp, Homo sapiens
tgccctgtggactcagttctggtgcc

SEQ ID NO: 27271 - DNA, 23 bp, Homo sapiens
gccctgtggactcagttctggtg

SEQ ID NO: 27272 - DNA, 24 bp, Homo sapiens
gccctgtggactcagttctggtgc

SEQ ID NO: 27273 - DNA, 23 bp, Homo sapiens
ccctgtggactcagttctggtgc

SEQ ID NO: 27274 - DNA, 24 bp, Homo sapiens
ctcggcgtggcgtcggtcgtggta

SEQ ID NO: 27275 - DNA, 25 bp, Homo sapiens
actcggcgtggcgtcggtcgtggta

SEQ ID NO: 27276 - DNA, 23 bp, Homo sapiens
ctcggcgtggcgtcggtcgtggt

SEQ ID NO: 27277 - DNA, 24 bp, Homo sapiens
actcggcgtggcgtcggtcgtggt

SEQ ID NO: 27278 - DNA, 22 bp, Homo sapiens
ctcggcgtggcgtcggtcgtgg

SEQ ID NO: 27279 - DNA, 23 bp, Homo sapiens
actcggcgtggcgtcggtcgtgg

SEQ ID NO: 27280 - DNA, 21 bp, Homo sapiens
ctcggcgtggcgtcggtcgtg

SEQ ID NO: 27281 - DNA, 19 bp, Homo sapiens
actcggcgtggcgtcggtc

SEQ ID NO: 27282 - DNA, 16 bp, Homo sapiens
ctcggcgtggcgtcgg

SEQ ID NO: 27283 - DNA, 17 bp, Homo sapiens
actcggcgtggcgtcgg

SEQ ID NO: 27284 - DNA, 16 bp, Homo sapiens
actcggcgtggcgtcg

SEQ ID NO: 27285 - DNA, 25 bp, Homo sapiens
tcgaccggacctcgaccggctcgtc

SEQ ID NO: 27286 - DNA, 24 bp, Homo sapiens
tcgaccggacctcgaccggctcgt

SEQ ID NO: 27287 - DNA, 23 bp, Homo sapiens
tcgaccggacctcgaccggctcg

SEQ ID NO: 27288 - DNA, 22 bp, Homo sapiens
tcgaccggacctcgaccggctc

SEQ ID NO: 27289 - DNA, 20 bp, Homo sapiens
cgaccggacctcgaccggct

SEQ ID NO: 27290 - DNA, 20 bp, Homo sapiens
tcgaccggacctcgaccggc

SEQ ID NO: 27291 - DNA, 19 bp, Homo sapiens
tcgaccggacctcgaccgg

SEQ ID NO: 27292 - DNA, 18 bp, Homo sapiens
tcgaccggacctcgaccg

SEQ ID NO: 27293 - DNA, 17 bp, Homo sapiens
tcgaccggacctcgacc

SEQ ID NO: 27294 - DNA, 26 bp, Homo sapiens
cagtagagggaggaatcgcagaaatc

SEQ ID NO: 27295 - DNA, 21 bp, Homo sapiens
cagtagagggaggaatcgcag

SEQ ID NO: 27296 - DNA, 20 bp, Homo sapiens
cagtagagggaggaatcgca

SEQ ID NO: 27297 - DNA, 21 bp, Homo sapiens
acagtagagggaggaatcgca

SEQ ID NO: 27298 - DNA, 18 bp, Homo sapiens
cagtagagggaggaatcg

SEQ ID NO: 27299 - DNA, 22 bp, Homo sapiens
tgggacagtagagggaggaatc

SEQ ID NO: 27300 - DNA, 24 bp, Homo sapiens
actgggacagtagagggaggaatc

SEQ ID NO: 27301 - DNA, 22 bp, Homo sapiens
agggtgtttctctcatctctgg

SEQ ID NO: 27302 - DNA, 23 bp, Homo sapiens
tagggtgtttctctcatctctgg

SEQ ID NO: 27303 - DNA, 22 bp, Homo sapiens
tagggtgtttctctcatctctg

SEQ ID NO: 27304 - DNA, 21 bp, Homo sapiens
tagggtgtttctctcatctct

SEQ ID NO: 27305 - DNA, 21 bp, Homo sapiens
cctagggtgtttctctcatct

SEQ ID NO: 27306 - DNA, 22 bp, Homo sapiens
tcctagggtgtttctctcatct

SEQ ID NO: 27307 - DNA, 27 bp, Homo sapiens
tttctatttctcagtggggctcttacc

SEQ ID NO: 27308 - DNA, 24 bp, Homo sapiens
tttctatttctcagtggggctctt

SEQ ID NO: 27309 - DNA, 23 bp, Homo sapiens
tttctatttctcagtggggctct

SEQ ID NO: 27310 - DNA, 17 bp, Homo sapiens
tatttctcagtggggct

SEQ ID NO: 27311 - DNA, 21 bp, Homo sapiens
tttctatttctcagtggggct

SEQ ID NO: 27312 - DNA, 20 bp, Homo sapiens
tttctatttctcagtggggc

SEQ ID NO: 27313 - DNA, 19 bp, Homo sapiens
tttctatttctcagtgggg

SEQ ID NO: 27314 - DNA, 23 bp, Homo sapiens
aacccagtgggctatggaaatgt

SEQ ID NO: 27315 - DNA, 21 bp, Homo sapiens
aacccagtgggctatggaaat

SEQ ID NO: 27316 - DNA, 20 bp, Homo sapiens
aacccagtgggctatggaaa

SEQ ID NO: 27317 - DNA, 19 bp, Homo sapiens
aacccagtgggctatggaa

SEQ ID NO: 27318 - DNA, 18 bp, Homo sapiens
aacccagtgggctatgga

SEQ ID NO: 27319 - DNA, 17 bp, Homo sapiens
aatataagaactcttgc

SEQ ID NO: 27320 - DNA, 18 bp, Homo sapiens
aatataagaactcttgca

SEQ ID NO: 27321 - DNA, 19 bp, Homo sapiens
aatataagaactcttgcag

SEQ ID NO: 27322 - DNA, 22 bp, Homo sapiens
aatataagaactcttgcagtct

SEQ ID NO: 27323 - DNA, 23 bp, Homo sapiens
ataagaactcttgcagtcttaga

SEQ ID NO: 27324 - DNA, 20 bp, Homo sapiens
taagaactcttgcagtctta

SEQ ID NO: 27325 - DNA, 22 bp, Homo sapiens
taagaactcttgcagtcttaga

SEQ ID NO: 27326 - DNA, 24 bp, Homo sapiens
taagaactcttgcagtcttagatg

SEQ ID NO: 27327 - DNA, 28 bp, Homo sapiens
aagaactcttgcagtcttagatgttata

SEQ ID NO: 27328 - DNA, 20 bp, Homo sapiens
agaactcttgcagtcttaga

SEQ ID NO: 27329 - DNA, 22 bp, Homo sapiens
agaactcttgcagtcttagatg

SEQ ID NO: 27330 - DNA, 24 bp, Homo sapiens
agaactcttgcagtcttagatgtt

SEQ ID NO: 27331 - DNA, 26 bp, Homo sapiens
agaactcttgcagtcttagatgttat

SEQ ID NO: 27332 - DNA, 28 bp, Homo sapiens
agaactcttgcagtcttagatgttataa

SEQ ID NO: 27333 - DNA, 26 bp, Homo sapiens
atatctgaattgtaagagttgttagc

SEQ ID NO: 27334 - DNA, 21 bp, Homo sapiens
atctgaattgtaagagttgtt

SEQ ID NO: 27335 - DNA, 20 bp, Homo sapiens
tctgaattgtaagagttgtt

SEQ ID NO: 27336 - DNA, 22 bp, Homo sapiens
tctgaattgtaagagttgttag

SEQ ID NO: 27337 - DNA, 23 bp, Homo sapiens
tctgaattgtaagagttgttagc

SEQ ID NO: 27338 - DNA, 20 bp, Homo sapiens
tgaattgtaagagttgttag

SEQ ID NO: 27339 - DNA, 21 bp, Homo sapiens
tgaattgtaagagttgttagc

SEQ ID NO: 27340 - DNA, 22 bp, Homo sapiens
tgaattgtaagagttgttagca

SEQ ID NO: 27341 - DNA, 23 bp, Homo sapiens
tgaattgtaagagttgttagcac

SEQ ID NO: 27342 - DNA, 17 bp, Homo sapiens
ttggtacaaaagcaatc

SEQ ID NO: 27343 - DNA, 20 bp, Homo sapiens
gtacaaaagcaatcgcggtt

SEQ ID NO: 27344 - DNA, 21 bp, Homo sapiens
gtacaaaagcaatcgcggttt

SEQ ID NO: 27345 - DNA, 22 bp, Homo sapiens
gtacaaaagcaatcgcggtttt

SEQ ID NO: 27346 - DNA, 27 bp, Homo sapiens
gtacaaaagcaatcgcggtttttgcta

SEQ ID NO: 27347 - DNA, 19 bp, Homo sapiens
caaaagcaatcgcggtttt

SEQ ID NO: 27348 - DNA, 20 bp, Homo sapiens
caaaagcaatcgcggttttt

SEQ ID NO: 27349 - DNA, 21 bp, Homo sapiens
caaaagcaatcgcggtttttg

SEQ ID NO: 27350 - DNA, 23 bp, Homo sapiens
caaaagcaatcgcggtttttgct

SEQ ID NO: 27351 - DNA, 24 bp, Homo sapiens
caaaagcaatcgcggtttttgcta

SEQ ID NO: 27352 - DNA, 27 bp, Homo sapiens
caaaagcaatcgcggtttttgctatta

SEQ ID NO: 27353 - DNA, 16 bp, Homo sapiens
aaaagcaatcgcggtt

SEQ ID NO: 27354 - DNA, 18 bp, Homo sapiens
aaaagcaatcgcggtttt

SEQ ID NO: 27355 - DNA, 19 bp, Homo sapiens
aaaagcaatcgcggttttt

SEQ ID NO: 27356 - DNA, 20 bp, Homo sapiens
aaaagcaatcgcggtttttg

SEQ ID NO: 27357 - DNA, 21 bp, Homo sapiens
aaaagcaatcgcggtttttgc

SEQ ID NO: 27358 - DNA, 22 bp, Homo sapiens
aaaagcaatcgcggtttttgct

SEQ ID NO: 27359 - DNA, 23 bp, Homo sapiens
aaaagcaatcgcggtttttgcta

SEQ ID NO: 27360 - DNA, 22 bp, Homo sapiens
caaaaactgagactacttttgc

SEQ ID NO: 27361 - DNA, 23 bp, Homo sapiens
caaaaactgagactacttttgca

SEQ ID NO: 27362 - DNA, 25 bp, Homo sapiens
caaaaactgagactacttttgcacc

SEQ ID NO: 27363 - DNA, 20 bp, Homo sapiens
aaaaactgagactacttttg

SEQ ID NO: 27364 - DNA, 21 bp, Homo sapiens
aaaaactgagactacttttgc

SEQ ID NO: 27365 - DNA, 23 bp, Homo sapiens
aaaaactgagactacttttgcac

SEQ ID NO: 27366 - DNA, 24 bp, Homo sapiens
aaaaactgagactacttttgcacc

SEQ ID NO: 27367 - DNA, 20 bp, Homo sapiens
aaaactgagactacttttgc

SEQ ID NO: 27368 - DNA, 21 bp, Homo sapiens
aaaactgagactacttttgca

SEQ ID NO: 27369 - DNA, 22 bp, Homo sapiens
aaaactgagactacttttgcac

SEQ ID NO: 27370 - DNA, 23 bp, Homo sapiens
aaaactgagactacttttgcacc

SEQ ID NO: 27371 - DNA, 20 bp, Homo sapiens
aaactgagactacttttgca

SEQ ID NO: 27372 - DNA, 22 bp, Homo sapiens
aaactgagactacttttgcacc

SEQ ID NO: 27373 - DNA, 23 bp, Homo sapiens
aaactgagactacttttgcacca

SEQ ID NO: 27374 - DNA, 25 bp, Homo sapiens
aaactgagactacttttgcaccaac

SEQ ID NO: 27375 - DNA, 21 bp, Homo sapiens
aactgagactacttttgcacc

SEQ ID NO: 27376 - DNA, 22 bp, Homo sapiens
aactgagactacttttgcacca

SEQ ID NO: 27377 - DNA, 23 bp, Homo sapiens
aactgagactacttttgcaccaa

SEQ ID NO: 27378 - DNA, 25 bp, Homo sapiens
ctcaaaccggctgtgcctgtggacg

SEQ ID NO: 27379 - DNA, 24 bp, Homo sapiens
ctcaaaccggctgtgcctgtggac

SEQ ID NO: 27380 - DNA, 23 bp, Homo sapiens
ctcaaaccggctgtgcctgtgga

SEQ ID NO: 27381 - DNA, 20 bp, Homo sapiens
caaaccggctgtgcctgtgg

SEQ ID NO: 27382 - DNA, 21 bp, Homo sapiens
ctcaaaccggctgtgcctgtg

SEQ ID NO: 27383 - DNA, 19 bp, Homo sapiens
ctcaaaccggctgtgcctg

SEQ ID NO: 27384 - DNA, 22 bp, Homo sapiens
acaggcacgactggtttggcaa

SEQ ID NO: 27385 - DNA, 20 bp, Homo sapiens
ccaaaccagtcgtgcctgtg

SEQ ID NO: 27386 - DNA, 22 bp, Homo sapiens
ccaaaccagtcgtgcctgtggg

SEQ ID NO: 27387 - DNA, 20 bp, Homo sapiens
caaaccagtcgtgcctgtgg

SEQ ID NO: 27388 - DNA, 22 bp, Homo sapiens
caaaccagtcgtgcctgtgggc

SEQ ID NO: 27389 - DNA, 19 bp, Homo sapiens
cagtgcaatgttttccttg

SEQ ID NO: 27390 - DNA, 20 bp, Homo sapiens
cagtgcaatgttttccttgc

SEQ ID NO: 27391 - DNA, 21 bp, Homo sapiens
cagtgcaatgttttccttgcc

SEQ ID NO: 27392 - DNA, 22 bp, Homo sapiens
cagtgcaatgttttccttgcct

SEQ ID NO: 27393 - DNA, 23 bp, Homo sapiens
cagtgcaatgttttccttgcctg

SEQ ID NO: 27394 - DNA, 18 bp, Homo sapiens
ggggtggtctgttgttgt

SEQ ID NO: 27395 - DNA, 16 bp, Homo sapiens
ggggtggtctgttgtt

SEQ ID NO: 27396 - DNA, 25 bp, Homo sapiens
ttggggaaacggccgctgagtgagg

SEQ ID NO: 27397 - DNA, 24 bp, Homo sapiens
ttggggaaacggccgctgagtgag

SEQ ID NO: 27398 - DNA, 22 bp, Homo sapiens
tggggaaacggccgctgagtga

SEQ ID NO: 27399 - DNA, 23 bp, Homo sapiens
ttggggaaacggccgctgagtga

SEQ ID NO: 27400 - DNA, 21 bp, Homo sapiens
ttggggaaacggccgctgagt

SEQ ID NO: 27401 - DNA, 20 bp, Homo sapiens
ttggggaaacggccgctgag

SEQ ID NO: 27402 - DNA, 19 bp, Homo sapiens
ttggggaaacggccgctga

SEQ ID NO: 27403 - DNA, 18 bp, Homo sapiens
ttggggaaacggccgctg

SEQ ID NO: 27404 - DNA, 17 bp, Homo sapiens
ttggggaaacggccgct

SEQ ID NO: 27405 - DNA, 16 bp, Homo sapiens
ttggggaaacggccgc

SEQ ID NO: 27406 - DNA, 18 bp, Homo sapiens
aggggtttggggaaacgg

SEQ ID NO: 27407 - DNA, 26 bp, Homo sapiens
tgagcaccacacaggccgggcgccgg

SEQ ID NO: 27408 - DNA, 24 bp, Homo sapiens
tgagcaccacacaggccgggcgcc

SEQ ID NO: 27409 - DNA, 22 bp, Homo sapiens
tgagcaccacacaggccgggcg

SEQ ID NO: 27410 - DNA, 21 bp, Homo sapiens
tgagcaccacacaggccgggc

SEQ ID NO: 27411 - DNA, 20 bp, Homo sapiens
tgagcaccacacaggccggg

SEQ ID NO: 27412 - DNA, 19 bp, Homo sapiens
tgagcaccacacaggccgg

SEQ ID NO: 27413 - DNA, 23 bp, Homo sapiens
gctggtctgcgtggtgctcgggt

SEQ ID NO: 27414 - DNA, 22 bp, Homo sapiens
gctggtctgcgtggtgctcggg

SEQ ID NO: 27415 - DNA, 22 bp, Homo sapiens
cgctggtctgcgtggtgctcgg

SEQ ID NO: 27416 - DNA, 20 bp, Homo sapiens
aacgggaatgcaggctgtat

SEQ ID NO: 27417 - DNA, 23 bp, Homo sapiens
aacgggaatgcaggctgtatctg

SEQ ID NO: 27418 - DNA, 24 bp, Homo sapiens
aacgggaatgcaggctgtatctgc

SEQ ID NO: 27419 - DNA, 22 bp, Homo sapiens
acgggaatgcaggctgtatctg

SEQ ID NO: 27420 - DNA, 21 bp, Homo sapiens
cgggaatgcaggctgtatctg

SEQ ID NO: 27421 - DNA, 22 bp, Homo sapiens
cgggaatgcaggctgtatctgc

SEQ ID NO: 27422 - DNA, 20 bp, Homo sapiens
tctgagttcctggagcctgg

SEQ ID NO: 27423 - DNA, 21 bp, Homo sapiens
tctgagttcctggagcctggt

SEQ ID NO: 27424 - DNA, 22 bp, Homo sapiens
tctgagttcctggagcctggtc

SEQ ID NO: 27425 - DNA, 26 bp, Homo sapiens
tctgagttcctggagcctggtctgtc

SEQ ID NO: 27426 - DNA, 20 bp, Homo sapiens
tgagttcctggagcctggtc

SEQ ID NO: 27427 - DNA, 22 bp, Homo sapiens
aaaagtaactgcggtttttgag

SEQ ID NO: 27428 - DNA, 23 bp, Homo sapiens
caaaagtaactgcggtttttgag

SEQ ID NO: 27429 - DNA, 22 bp, Homo sapiens
caaaagtaactgcggtttttga

SEQ ID NO: 27430 - DNA, 20 bp, Homo sapiens
ttttacacacaactgaggat

SEQ ID NO: 27431 - DNA, 22 bp, Homo sapiens
ttttacacacaactgaggatca

SEQ ID NO: 27432 - DNA, 24 bp, Homo sapiens
ttttacacacaactgaggatcata

SEQ ID NO: 27433 - DNA, 19 bp, Homo sapiens
ttacacacaactgaggatc

SEQ ID NO: 27434 - DNA, 20 bp, Homo sapiens
ttacacacaactgaggatca

SEQ ID NO: 27435 - DNA, 21 bp, Homo sapiens
ttacacacaactgaggatcat

SEQ ID NO: 27436 - DNA, 24 bp, Homo sapiens
ttacacacaactgaggatcatagc

SEQ ID NO: 27437 - DNA, 21 bp, Homo sapiens
acacacaactgaggatcatag

SEQ ID NO: 27438 - DNA, 22 bp, Homo sapiens
acacacaactgaggatcatagc

SEQ ID NO: 27439 - DNA, 23 bp, Homo sapiens
acacacaactgaggatcatagcc

SEQ ID NO: 27440 - DNA, 22 bp, Homo sapiens
cacacaactgaggatcatagcc

SEQ ID NO: 27441 - DNA, 17 bp, Homo sapiens
tgaggatcatagcctga

SEQ ID NO: 27442 - DNA, 20 bp, Homo sapiens
tagccaagtggaagttactt

SEQ ID NO: 27443 - DNA, 22 bp, Homo sapiens
tagccaagtggaagttacttta

SEQ ID NO: 27444 - DNA, 19 bp, Homo sapiens
agccaagtggaagttactt

SEQ ID NO: 27445 - DNA, 23 bp, Homo sapiens
agccaagtggaagttactttacc

SEQ ID NO: 27446 - DNA, 25 bp, Homo sapiens
agccaagtggaagttactttacctc

SEQ ID NO: 27447 - DNA, 21 bp, Homo sapiens
aaaaaggcgggagaagcccca

SEQ ID NO: 27448 - DNA, 22 bp, Homo sapiens
aaaaaggcgggagaagccccag

SEQ ID NO: 27449 - DNA, 23 bp, Homo sapiens
aaaaaggcgggagaagccccagc

SEQ ID NO: 27450 - DNA, 27 bp, Homo sapiens
aaaaaggcgggagaagccccagcagaa

SEQ ID NO: 27451 - DNA, 22 bp, Homo sapiens
aaaaggcgggagaagccccagc

SEQ ID NO: 27452 - DNA, 26 bp, Homo sapiens
aaaaggcgggagaagccccagcagaa

SEQ ID NO: 27453 - DNA, 19 bp, Homo sapiens
aaaggcgggagaagcccca

SEQ ID NO: 27454 - DNA, 20 bp, Homo sapiens
aaaggcgggagaagccccag

SEQ ID NO: 27455 - DNA, 21 bp, Homo sapiens
aaaggcgggagaagccccagc

SEQ ID NO: 27456 - DNA, 22 bp, Homo sapiens
aaaggcgggagaagccccagca

SEQ ID NO: 27457 - DNA, 24 bp, Homo sapiens
aaaggcgggagaagccccagcaga

SEQ ID NO: 27458 - DNA, 25 bp, Homo sapiens
aaaggcgggagaagccccagcagaa

SEQ ID NO: 27459 - DNA, 18 bp, Homo sapiens
aaggcgggagaagcccca

SEQ ID NO: 27460 - DNA, 19 bp, Homo sapiens
aaggcgggagaagccccag

SEQ ID NO: 27461 - DNA, 20 bp, Homo sapiens
aaggcgggagaagccccagc

SEQ ID NO: 27462 - DNA, 21 bp, Homo sapiens
aaggcgggagaagccccagca

SEQ ID NO: 27463 - DNA, 23 bp, Homo sapiens
aaggcgggagaagccccagcaga

SEQ ID NO: 27464 - DNA, 24 bp, Homo sapiens
aaggcgggagaagccccagcagaa

SEQ ID NO: 27465 - DNA, 17 bp, Homo sapiens
aggcgggagaagcccca

SEQ ID NO: 27466 - DNA, 18 bp, Homo sapiens
aggcgggagaagccccag

SEQ ID NO: 27467 - DNA, 23 bp, Homo sapiens
aggcgggagaagccccagcagaa

SEQ ID NO: 27468 - DNA, 20 bp, Homo sapiens
acttggagtcagaagagtgg

SEQ ID NO: 27469 - DNA, 24 bp, Homo sapiens
ctggacttggagtcagaagagtgg

SEQ ID NO: 27470 - DNA, 24 bp, Homo sapiens
actggacttggagtcagaagagtg

SEQ ID NO: 27471 - DNA, 22 bp, Homo sapiens
ctggacttggagtcagaagagt

SEQ ID NO: 27472 - DNA, 23 bp, Homo sapiens
actggacttggagtcagaagagt

SEQ ID NO: 27473 - DNA, 21 bp, Homo sapiens
ctggacttggagtcagaagag

SEQ ID NO: 27474 - DNA, 22 bp, Homo sapiens
actggacttggagtcagaagag

SEQ ID NO: 27475 - DNA, 23 bp, Homo sapiens
cactggacttggagtcagaagag

SEQ ID NO: 27476 - DNA, 22 bp, Homo sapiens
cactggacttggagtcagaaga

SEQ ID NO: 27477 - DNA, 24 bp, Homo sapiens
agaggtatagggcatgggaaaacg

SEQ ID NO: 27478 - DNA, 23 bp, Homo sapiens
agaggtatagggcatgggaaaac

SEQ ID NO: 27479 - DNA, 24 bp, Homo sapiens
aagaggtatagggcatgggaaaac

SEQ ID NO: 27480 - DNA, 26 bp, Homo sapiens
taaagaggtatagggcatgggaaaac

SEQ ID NO: 27481 - DNA, 22 bp, Homo sapiens
agaggtatagggcatgggaaaa

SEQ ID NO: 27482 - DNA, 21 bp, Homo sapiens
agaggtatagggcatgggaaa

SEQ ID NO: 27483 - DNA, 22 bp, Homo sapiens
aagaggtatagggcatgggaaa

SEQ ID NO: 27484 - DNA, 21 bp, Homo sapiens
aagaggtatagggcatgggaa

SEQ ID NO: 27485 - DNA, 20 bp, Homo sapiens
aagaggtatagggcatggga

SEQ ID NO: 27486 - DNA, 24 bp, Homo sapiens
ttcctatgcatatacttctttgag

SEQ ID NO: 27487 - DNA, 23 bp, Homo sapiens
ttcctatgcatatacttctttga

SEQ ID NO: 27488 - DNA, 21 bp, Homo sapiens
ttcctatgcatatacttcttt

SEQ ID NO: 27489 - DNA, 22 bp, Homo sapiens
tttcctatgcatatacttcttt

SEQ ID NO: 27490 - DNA, 20 bp, Homo sapiens
ttcctatgcatatacttctt

SEQ ID NO: 27491 - DNA, 19 bp, Homo sapiens
ttcctatgcatatacttct

SEQ ID NO: 27492 - DNA, 20 bp, Homo sapiens
tttcctatgcatatacttct

SEQ ID NO: 27493 - DNA, 19 bp, Homo sapiens
cctgctgctccggacctgt

SEQ ID NO: 27494 - DNA, 24 bp, Homo sapiens
cgggctggcctgctgctccggacc

SEQ ID NO: 27495 - DNA, 26 bp, Homo sapiens
ttcgggctggcctgctgctccggacc

SEQ ID NO: 27496 - DNA, 25 bp, Homo sapiens
ttcgggctggcctgctgctccggac

SEQ ID NO: 27497 - DNA, 22 bp, Homo sapiens
cgggctggcctgctgctccgga

SEQ ID NO: 27498 - DNA, 24 bp, Homo sapiens
ttcgggctggcctgctgctccgga

SEQ ID NO: 27499 - DNA, 21 bp, Homo sapiens
cgggctggcctgctgctccgg

SEQ ID NO: 27500 - DNA, 22 bp, Homo sapiens
tcgggctggcctgctgctccgg

SEQ ID NO: 27501 - DNA, 22 bp, Homo sapiens
ttcgggctggcctgctgctccg

SEQ ID NO: 27502 - DNA, 20 bp, Homo sapiens
ttcgggctggcctgctgctc

SEQ ID NO: 27503 - DNA, 19 bp, Homo sapiens
ttcgggctggcctgctgct

SEQ ID NO: 27504 - DNA, 24 bp, Homo sapiens
tgtgcagcaggccaaccgagaagc

SEQ ID NO: 27505 - DNA, 25 bp, Homo sapiens
ctgtgcagcaggccaaccgagaagc

SEQ ID NO: 27506 - DNA, 23 bp, Homo sapiens
tgtgcagcaggccaaccgagaag

SEQ ID NO: 27507 - DNA, 22 bp, Homo sapiens
tgtgcagcaggccaaccgagaa

SEQ ID NO: 27508 - DNA, 23 bp, Homo sapiens
ctgtgcagcaggccaaccgagaa

SEQ ID NO: 27509 - DNA, 22 bp, Homo sapiens
ctgtgcagcaggccaaccgaga

SEQ ID NO: 27510 - DNA, 20 bp, Homo sapiens
tgtgcagcaggccaaccgag

SEQ ID NO: 27511 - DNA, 21 bp, Homo sapiens
ctgtgcagcaggccaaccgag

SEQ ID NO: 27512 - DNA, 19 bp, Homo sapiens
tgtgcagcaggccaaccga

SEQ ID NO: 27513 - DNA, 22 bp, Homo sapiens
tcctgtgcagcaggccaaccga

SEQ ID NO: 27514 - DNA, 18 bp, Homo sapiens
tgtgcagcaggccaaccg

SEQ ID NO: 27515 - DNA, 23 bp, Homo sapiens
cacaccagcctgacaggaacagc

SEQ ID NO: 27516 - DNA, 22 bp, Homo sapiens
cacaccagcctgacaggaacag

SEQ ID NO: 27517 - DNA, 21 bp, Homo sapiens
cacaccagcctgacaggaaca

SEQ ID NO: 27518 - DNA, 23 bp, Homo sapiens
caggatgtggtcaagtgttgtta

SEQ ID NO: 27519 - DNA, 21 bp, Homo sapiens
ggggctgtgattgaccagcag

SEQ ID NO: 27520 - DNA, 18 bp, Homo sapiens
ttgaccagcaggacttct

SEQ ID NO: 27521 - DNA, 26 bp, Homo sapiens
ccccagggcgacgcggcgggggcggc

SEQ ID NO: 27522 - DNA, 25 bp, Homo sapiens
ccccagggcgacgcggcgggggcgg

SEQ ID NO: 27523 - DNA, 24 bp, Homo sapiens
ccccagggcgacgcggcgggggcg

SEQ ID NO: 27524 - DNA, 23 bp, Homo sapiens
ccccagggcgacgcggcgggggc

SEQ ID NO: 27525 - DNA, 22 bp, Homo sapiens
ccccagggcgacgcggcggggg

SEQ ID NO: 27526 - DNA, 21 bp, Homo sapiens
ccccagggcgacgcggcgggg

SEQ ID NO: 27527 - DNA, 19 bp, Homo sapiens
ccccagggcgacgcggcgg

SEQ ID NO: 27528 - DNA, 17 bp, Homo sapiens
ccccagggcgacgcggc

SEQ ID NO: 27529 - DNA, 20 bp, Homo sapiens
ttgctgcccgggccgtgcac

SEQ ID NO: 27530 - DNA, 26 bp, Homo sapiens
accttgccttgctgcccgggccgtgc

SEQ ID NO: 27531 - DNA, 24 bp, Homo sapiens
accttgccttgctgcccgggccgt

SEQ ID NO: 27532 - DNA, 25 bp, Homo sapiens
caccttgccttgctgcccgggccgt

SEQ ID NO: 27533 - DNA, 23 bp, Homo sapiens
accttgccttgctgcccgggccg

SEQ ID NO: 27534 - DNA, 24 bp, Homo sapiens
caccttgccttgctgcccgggccg

SEQ ID NO: 27535 - DNA, 23 bp, Homo sapiens
caccttgccttgctgcccgggcc

SEQ ID NO: 27536 - DNA, 21 bp, Homo sapiens
accttgccttgctgcccgggc

SEQ ID NO: 27537 - DNA, 22 bp, Homo sapiens
caccttgccttgctgcccgggc

SEQ ID NO: 27538 - DNA, 21 bp, Homo sapiens
caccttgccttgctgcccggg

SEQ ID NO: 27539 - DNA, 20 bp, Homo sapiens
caccttgccttgctgcccgg

SEQ ID NO: 27540 - DNA, 18 bp, Homo sapiens
caccttgccttgctgccc

SEQ ID NO: 27541 - DNA, 28 bp, Homo sapiens
gagcctggaagctggagcctgcagtgag

SEQ ID NO: 27542 - DNA, 27 bp, Homo sapiens
agcctggaagctggagcctgcagtgag

SEQ ID NO: 27543 - DNA, 28 bp, Homo sapiens
agcctggaagctggagcctgcagtgagc

SEQ ID NO: 27544 - DNA, 22 bp, Homo sapiens
gcacacactgcaattacttttg

SEQ ID NO: 27545 - DNA, 23 bp, Homo sapiens
gcacacactgcaattacttttgc

SEQ ID NO: 27546 - DNA, 21 bp, Homo sapiens
cacacactgcaattacttttg

SEQ ID NO: 27547 - DNA, 24 bp, Homo sapiens
cacacactgcaattacttttgctc

SEQ ID NO: 27548 - DNA, 22 bp, Homo sapiens
tagtctggactgatatggttag

SEQ ID NO: 27549 - DNA, 16 bp, Homo sapiens
ctgcggaattcaggac

SEQ ID NO: 27550 - DNA, 27 bp, Homo sapiens
gcccttaaaggtgaacccagtgcacct

SEQ ID NO: 27551 - DNA, 21 bp, Homo sapiens
cttaaaggtgaacccagtgca

SEQ ID NO: 27552 - DNA, 23 bp, Homo sapiens
tgcccttaaaggtgaacccagtg

SEQ ID NO: 27553 - DNA, 21 bp, Homo sapiens
gcccttaaaggtgaacccagt

SEQ ID NO: 27554 - DNA, 21 bp, Homo sapiens
tgcccttaaaggtgaacccag

SEQ ID NO: 27555 - DNA, 25 bp, Homo sapiens
ttgtgaagaaagaaattcttactag

SEQ ID NO: 27556 - DNA, 24 bp, Homo sapiens
ttgtgaagaaagaaattcttacta

SEQ ID NO: 27557 - DNA, 22 bp, Homo sapiens
tgtgaagaaagaaattcttact

SEQ ID NO: 27558 - DNA, 23 bp, Homo sapiens
ttgtgaagaaagaaattcttact

SEQ ID NO: 27559 - DNA, 22 bp, Homo sapiens
ttgtgaagaaagaaattcttac

SEQ ID NO: 27560 - DNA, 20 bp, Homo sapiens
tgtgaagaaagaaattctta

SEQ ID NO: 27561 - DNA, 20 bp, Homo sapiens
ttgtgaagaaagaaattctt

SEQ ID NO: 27562 - DNA, 19 bp, Homo sapiens
ttgtgaagaaagaaattct

SEQ ID NO: 27563 - DNA, 26 bp, Homo sapiens
tggagatccagtgctcgcccgatctc

SEQ ID NO: 27564 - DNA, 25 bp, Homo sapiens
tggagatccagtgctcgcccgatct

SEQ ID NO: 27565 - DNA, 24 bp, Homo sapiens
tggagatccagtgctcgcccgatc

SEQ ID NO: 27566 - DNA, 22 bp, Homo sapiens
ggagatccagtgctcgcccgat

SEQ ID NO: 27567 - DNA, 22 bp, Homo sapiens
tggagatccagtgctcgcccga

SEQ ID NO: 27568 - DNA, 21 bp, Homo sapiens
tggagatccagtgctcgcccg

SEQ ID NO: 27569 - DNA, 20 bp, Homo sapiens
tggagatccagtgctcgccc

SEQ ID NO: 27570 - DNA, 19 bp, Homo sapiens
tggagatccagtgctcgcc

SEQ ID NO: 27571 - DNA, 18 bp, Homo sapiens
tggagatccagtgctcgc

SEQ ID NO: 27572 - DNA, 23 bp, Homo sapiens
catgggttcagatcccagcggtg

SEQ ID NO: 27573 - DNA, 25 bp, Homo sapiens
ggttcagatcccagcggtgcctcta

SEQ ID NO: 27574 - DNA, 18 bp, Homo sapiens
tcagatcccagcggtgcc

SEQ ID NO: 27575 - DNA, 19 bp, Homo sapiens
tcagatcccagcggtgcct

SEQ ID NO: 27576 - DNA, 22 bp, Homo sapiens
tcagatcccagcggtgcctcta

SEQ ID NO: 27577 - DNA, 21 bp, Homo sapiens
cagatcccagcggtgcctcta

SEQ ID NO: 27578 - DNA, 20 bp, Homo sapiens
agatcccagcggtgcctcta

SEQ ID NO: 27579 - DNA, 16 bp, Homo sapiens
gatcccagcggtgcct

SEQ ID NO: 27580 - DNA, 17 bp, Homo sapiens
gatcccagcggtgcctc

SEQ ID NO: 27581 - DNA, 19 bp, Homo sapiens
gatcccagcggtgcctcta

SEQ ID NO: 27582 - DNA, 18 bp, Homo sapiens
atcccagcggtgcctcta

SEQ ID NO: 27583 - DNA, 19 bp, Homo sapiens
atcccagcggtgcctctaa

SEQ ID NO: 27584 - DNA, 20 bp, Homo sapiens
atcccagcggtgcctctaac

SEQ ID NO: 27585 - DNA, 21 bp, Homo sapiens
atcccagcggtgcctctaact

SEQ ID NO: 27586 - DNA, 22 bp, Homo sapiens
atcccagcggtgcctctaactg

SEQ ID NO: 27587 - DNA, 16 bp, Homo sapiens
tcccagcggtgcctct

SEQ ID NO: 27588 - DNA, 17 bp, Homo sapiens
tcccagcggtgcctcta

SEQ ID NO: 27589 - DNA, 16 bp, Homo sapiens
cccagcggtgcctcta

SEQ ID NO: 27590 - DNA, 17 bp, Homo sapiens
cccagcggtgcctctaa

SEQ ID NO: 27591 - DNA, 17 bp, Homo sapiens
ccagcggtgcctctaac

SEQ ID NO: 27592 - DNA, 22 bp, Homo sapiens
ttctaaatcccatggtgccttc

SEQ ID NO: 27593 - DNA, 22 bp, Homo sapiens
tctaaatcccatggtgccttct

SEQ ID NO: 27594 - DNA, 21 bp, Homo sapiens
ctaaatcccatggtgccttct

SEQ ID NO: 27595 - DNA, 22 bp, Homo sapiens
ctaaatcccatggtgccttctc

SEQ ID NO: 27596 - DNA, 23 bp, Homo sapiens
ctaaatcccatggtgccttctcc

SEQ ID NO: 27597 - DNA, 20 bp, Homo sapiens
taaatcccatggtgccttct

SEQ ID NO: 27598 - DNA, 21 bp, Homo sapiens
taaatcccatggtgccttctc

SEQ ID NO: 27599 - DNA, 22 bp, Homo sapiens
taaatcccatggtgccttctcc

SEQ ID NO: 27600 - DNA, 24 bp, Homo sapiens
taaatcccatggtgccttctcctt

SEQ ID NO: 27601 - DNA, 25 bp, Homo sapiens
taaatcccatggtgccttctccttg

SEQ ID NO: 27602 - DNA, 19 bp, Homo sapiens
agaaggcactatgagattt

SEQ ID NO: 27603 - DNA, 21 bp, Homo sapiens
agaaggcactatgagatttag

SEQ ID NO: 27604 - DNA, 23 bp, Homo sapiens
agaaggcactatgagatttagaa

SEQ ID NO: 27605 - DNA, 25 bp, Homo sapiens
agaaggcactatgagatttagaatc

SEQ ID NO: 27606 - DNA, 20 bp, Homo sapiens
gaaggcactatgagatttag

SEQ ID NO: 27607 - DNA, 21 bp, Homo sapiens
gaaggcactatgagatttaga

SEQ ID NO: 27608 - DNA, 22 bp, Homo sapiens
gaaggcactatgagatttagaa

SEQ ID NO: 27609 - DNA, 24 bp, Homo sapiens
gaaggcactatgagatttagaatc

SEQ ID NO: 27610 - DNA, 21 bp, Homo sapiens
aaggcactatgagatttagaa

SEQ ID NO: 27611 - DNA, 22 bp, Homo sapiens
aaggcactatgagatttagaat

SEQ ID NO: 27612 - DNA, 22 bp, Homo sapiens
aactgtaattacttttggacca

SEQ ID NO: 27613 - DNA, 23 bp, Homo sapiens
aaactgtaattacttttggacca

SEQ ID NO: 27614 - DNA, 21 bp, Homo sapiens
aactgtaattacttttggacc

SEQ ID NO: 27615 - DNA, 22 bp, Homo sapiens
aaactgtaattacttttggacc

SEQ ID NO: 27616 - DNA, 23 bp, Homo sapiens
aaaactgtaattacttttggacc

SEQ ID NO: 27617 - DNA, 20 bp, Homo sapiens
aactgtaattacttttggac

SEQ ID NO: 27618 - DNA, 21 bp, Homo sapiens
aaactgtaattacttttggac

SEQ ID NO: 27619 - DNA, 22 bp, Homo sapiens
aaaactgtaattacttttggac

SEQ ID NO: 27620 - DNA, 19 bp, Homo sapiens
atatgtatatgtgactgct

SEQ ID NO: 27621 - DNA, 21 bp, Homo sapiens
ccaggctctgcagtgggaggt

SEQ ID NO: 27622 - DNA, 20 bp, Homo sapiens
ccaggctctgcagtgggagg

SEQ ID NO: 27623 - DNA, 20 bp, Homo sapiens
cttcccaggctctgcagtgg

SEQ ID NO: 27624 - DNA, 22 bp, Homo sapiens
tcccaggctctgcagtgggaac

SEQ ID NO: 27625 - DNA, 19 bp, Homo sapiens
ccaggctctgcagtgggaa

SEQ ID NO: 27626 - DNA, 20 bp, Homo sapiens
ccaggctctgcagtgggaac

SEQ ID NO: 27627 - DNA, 22 bp, Homo sapiens
ccaggctctgcagtgggaactg

SEQ ID NO: 27628 - DNA, 23 bp, Homo sapiens
ccaggctctgcagtgggaactga

SEQ ID NO: 27629 - DNA, 22 bp, Homo sapiens
caggctctgcagtgggaactga

SEQ ID NO: 27630 - DNA, 24 bp, Homo sapiens
agtggggcttcgaccctaacccag

SEQ ID NO: 27631 - DNA, 23 bp, Homo sapiens
agtggggcttcgaccctaaccca

SEQ ID NO: 27632 - DNA, 22 bp, Homo sapiens
agtggggcttcgaccctaaccc

SEQ ID NO: 27633 - DNA, 23 bp, Homo sapiens
gagtggggcttcgaccctaaccc

SEQ ID NO: 27634 - DNA, 21 bp, Homo sapiens
agtggggcttcgaccctaacc

SEQ ID NO: 27635 - DNA, 23 bp, Homo sapiens
ggagtggggcttcgaccctaacc

SEQ ID NO: 27636 - DNA, 27 bp, Homo sapiens
gtggggagtggggcttcgaccctaacc

SEQ ID NO: 27637 - DNA, 20 bp, Homo sapiens
agtggggcttcgaccctaac

SEQ ID NO: 27638 - DNA, 22 bp, Homo sapiens
ggagtggggcttcgaccctaac

SEQ ID NO: 27639 - DNA, 19 bp, Homo sapiens
agtggggcttcgaccctaa

SEQ ID NO: 27640 - DNA, 20 bp, Homo sapiens
gagtggggcttcgaccctaa

SEQ ID NO: 27641 - DNA, 21 bp, Homo sapiens
ggagtggggcttcgaccctaa

SEQ ID NO: 27642 - DNA, 26 bp, Homo sapiens
tgtggggagtggggcttcgaccctaa

SEQ ID NO: 27643 - DNA, 18 bp, Homo sapiens
agtggggcttcgacccta

SEQ ID NO: 27644 - DNA, 25 bp, Homo sapiens
tgtggggagtggggcttcgacccta

SEQ ID NO: 27645 - DNA, 17 bp, Homo sapiens
agtggggcttcgaccct

SEQ ID NO: 27646 - DNA, 19 bp, Homo sapiens
gtggggagtggggcttcga

SEQ ID NO: 27647 - DNA, 19 bp, Homo sapiens
tgtggggagtggggcttcg

SEQ ID NO: 27648 - DNA, 27 bp, Homo sapiens
ttagggccctggctccatctcctttag

SEQ ID NO: 27649 - DNA, 24 bp, Homo sapiens
tagggccctggctccatctccttt

SEQ ID NO: 27650 - DNA, 25 bp, Homo sapiens
ttagggccctggctccatctccttt

SEQ ID NO: 27651 - DNA, 23 bp, Homo sapiens
tagggccctggctccatctcctt

SEQ ID NO: 27652 - DNA, 24 bp, Homo sapiens
ttagggccctggctccatctcctt

SEQ ID NO: 27653 - DNA, 22 bp, Homo sapiens
tagggccctggctccatctcct

SEQ ID NO: 27654 - DNA, 23 bp, Homo sapiens
ttagggccctggctccatctcct

SEQ ID NO: 27655 - DNA, 21 bp, Homo sapiens
tagggccctggctccatctcc

SEQ ID NO: 27656 - DNA, 21 bp, Homo sapiens
ttagggccctggctccatctc

SEQ ID NO: 27657 - DNA, 20 bp, Homo sapiens
ttagggccctggctccatct

SEQ ID NO: 27658 - DNA, 25 bp, Homo sapiens
tgtctttccttgttggagcagggat

SEQ ID NO: 27659 - DNA, 24 bp, Homo sapiens
tgtctttccttgttggagcaggga

SEQ ID NO: 27660 - DNA, 22 bp, Homo sapiens
gtctttccttgttggagcaggg

SEQ ID NO: 27661 - DNA, 23 bp, Homo sapiens
tgtctttccttgttggagcaggg

SEQ ID NO: 27662 - DNA, 22 bp, Homo sapiens
tgtctttccttgttggagcagg

SEQ ID NO: 27663 - DNA, 21 bp, Homo sapiens
tgtctttccttgttggagcag

SEQ ID NO: 27664 - DNA, 24 bp, Homo sapiens
tcctgtctttccttgttggagcag

SEQ ID NO: 27665 - DNA, 20 bp, Homo sapiens
tgtctttccttgttggagca

SEQ ID NO: 27666 - DNA, 21 bp, Homo sapiens
ctgtctttccttgttggagca

SEQ ID NO: 27667 - DNA, 23 bp, Homo sapiens
tcctgtctttccttgttggagca

SEQ ID NO: 27668 - DNA, 19 bp, Homo sapiens
tgtctttccttgttggagc

SEQ ID NO: 27669 - DNA, 20 bp, Homo sapiens
ctgtctttccttgttggagc

SEQ ID NO: 27670 - DNA, 18 bp, Homo sapiens
tgtctttccttgttggag

SEQ ID NO: 27671 - DNA, 21 bp, Homo sapiens
tcctgtctttccttgttggag

SEQ ID NO: 27672 - DNA, 22 bp, Homo sapiens
ctggcctcctgtctttccttgt

SEQ ID NO: 27673 - DNA, 21 bp, Homo sapiens
acaaggaaggacaagaggtgt

SEQ ID NO: 27674 - DNA, 25 bp, Homo sapiens
cccaacaaggaaggacaagaggtgt

SEQ ID NO: 27675 - DNA, 28 bp, Homo sapiens
tgccccaacaaggaaggacaagaggtgt

SEQ ID NO: 27676 - DNA, 20 bp, Homo sapiens
acaaggaaggacaagaggtg

SEQ ID NO: 27677 - DNA, 19 bp, Homo sapiens
acaaggaaggacaagaggt

SEQ ID NO: 27678 - DNA, 24 bp, Homo sapiens
tgccccaacaaggaaggacaagag

SEQ ID NO: 27679 - DNA, 21 bp, Homo sapiens
ccccaacaaggaaggacaaga

SEQ ID NO: 27680 - DNA, 23 bp, Homo sapiens
tgccccaacaaggaaggacaaga

SEQ ID NO: 27681 - DNA, 21 bp, Homo sapiens
tgccccaacaaggaaggacaa

SEQ ID NO: 27682 - DNA, 20 bp, Homo sapiens
tgccccaacaaggaaggaca

SEQ ID NO: 27683 - DNA, 19 bp, Homo sapiens
tgccccaacaaggaaggac

SEQ ID NO: 27684 - DNA, 18 bp, Homo sapiens
tgccccaacaaggaagga

SEQ ID NO: 27685 - DNA, 26 bp, Homo sapiens
cctacaggctggaatgggctcaaagc

SEQ ID NO: 27686 - DNA, 24 bp, Homo sapiens
cctacaggctggaatgggctcaaa

SEQ ID NO: 27687 - DNA, 23 bp, Homo sapiens
cctacaggctggaatgggctcaa

SEQ ID NO: 27688 - DNA, 22 bp, Homo sapiens
cctacaggctggaatgggctca

SEQ ID NO: 27689 - DNA, 21 bp, Homo sapiens
cctacaggctggaatgggctc

SEQ ID NO: 27690 - DNA, 20 bp, Homo sapiens
cctacaggctggaatgggct

SEQ ID NO: 27691 - DNA, 27 bp, Homo sapiens
gatccatctctgcctgtattggcttgg

SEQ ID NO: 27692 - DNA, 25 bp, Homo sapiens
gatccatctctgcctgtattggctt

SEQ ID NO: 27693 - DNA, 21 bp, Homo sapiens
ccatctctgcctgtattggct

SEQ ID NO: 27694 - DNA, 24 bp, Homo sapiens
gatccatctctgcctgtattggct

SEQ ID NO: 27695 - DNA, 22 bp, Homo sapiens
gatccatctctgcctgtattgg

SEQ ID NO: 27696 - DNA, 21 bp, Homo sapiens
gatccatctctgcctgtattg

SEQ ID NO: 27697 - DNA, 20 bp, Homo sapiens
gatccatctctgcctgtatt

SEQ ID NO: 27698 - DNA, 28 bp, Homo sapiens
gagcctggaagctggagcctgcagtgaa

SEQ ID NO: 27699 - DNA, 27 bp, Homo sapiens
agcctggaagctggagcctgcagtgaa

SEQ ID NO: 27700 - DNA, 28 bp, Homo sapiens
agcctggaagctggagcctgcagtgaac

SEQ ID NO: 27701 - DNA, 20 bp, Homo sapiens
actttcctgtcctccaacca

SEQ ID NO: 27702 - DNA, 21 bp, Homo sapiens
actttcctgtcctccaaccag

SEQ ID NO: 27703 - DNA, 22 bp, Homo sapiens
actttcctgtcctccaaccaga

SEQ ID NO: 27704 - DNA, 23 bp, Homo sapiens
actttcctgtcctccaaccagac

SEQ ID NO: 27705 - DNA, 24 bp, Homo sapiens
actttcctgtcctccaaccagacc

SEQ ID NO: 27706 - DNA, 21 bp, Homo sapiens
ctttcctgtcctccaaccaga

SEQ ID NO: 27707 - DNA, 25 bp, Homo sapiens
tttcctgtcctccaaccagaccatg

SEQ ID NO: 27708 - DNA, 19 bp, Homo sapiens
ttcctgtcctccaaccaga

SEQ ID NO: 27709 - DNA, 17 bp, Homo sapiens
tctggtcctggacagga

SEQ ID NO: 27710 - DNA, 18 bp, Homo sapiens
tctggtcctggacaggag

SEQ ID NO: 27711 - DNA, 19 bp, Homo sapiens
tctggtcctggacaggagg

SEQ ID NO: 27712 - DNA, 21 bp, Homo sapiens
tctggtcctggacaggaggcc

SEQ ID NO: 27713 - DNA, 22 bp, Homo sapiens
tctggtcctggacaggaggccg

SEQ ID NO: 27714 - DNA, 23 bp, Homo sapiens
tctggtcctggacaggaggccgc

SEQ ID NO: 27715 - DNA, 24 bp, Homo sapiens
tctggtcctggacaggaggccgct

SEQ ID NO: 27716 - DNA, 23 bp, Homo sapiens
gaaagagccagtggtgagacagt

SEQ ID NO: 27717 - DNA, 21 bp, Homo sapiens
agagccagtggtgagacagtg

SEQ ID NO: 27718 - DNA, 22 bp, Homo sapiens
agagccagtggtgagacagtga

SEQ ID NO: 27719 - DNA, 20 bp, Homo sapiens
gagccagtggtgagacagtg

SEQ ID NO: 27720 - DNA, 22 bp, Homo sapiens
gagccagtggtgagacagtgag

SEQ ID NO: 27721 - DNA, 23 bp, Homo sapiens
gagccagtggtgagacagtgagt

SEQ ID NO: 27722 - DNA, 24 bp, Homo sapiens
gagccagtggtgagacagtgagtt

SEQ ID NO: 27723 - DNA, 22 bp, Homo sapiens
tctcactgtttcaccactggct

SEQ ID NO: 27724 - DNA, 19 bp, Homo sapiens
cactgtttcaccactggct

SEQ ID NO: 27725 - DNA, 20 bp, Homo sapiens
cactgtttcaccactggctc

SEQ ID NO: 27726 - DNA, 21 bp, Homo sapiens
cactgtttcaccactggctct

SEQ ID NO: 27727 - DNA, 23 bp, Homo sapiens
cactgtttcaccactggctcttt

SEQ ID NO: 27728 - DNA, 24 bp, Homo sapiens
cactgtttcaccactggctctttg

SEQ ID NO: 27729 - DNA, 25 bp, Homo sapiens
cactgtttcaccactggctctttgg

SEQ ID NO: 27730 - DNA, 18 bp, Homo sapiens
actgtttcaccactggct

SEQ ID NO: 27731 - DNA, 20 bp, Homo sapiens
actgtttcaccactggctct

SEQ ID NO: 27732 - DNA, 21 bp, Homo sapiens
actgtttcaccactggctctt

SEQ ID NO: 27733 - DNA, 22 bp, Homo sapiens
actgtttcaccactggctcttt

SEQ ID NO: 27734 - DNA, 23 bp, Homo sapiens
actgtttcaccactggctctttg

SEQ ID NO: 27735 - DNA, 16 bp, Homo sapiens
catagtaaactactga

SEQ ID NO: 27736 - DNA, 18 bp, Homo sapiens
catagtaaactactgaaa

SEQ ID NO: 27737 - DNA, 23 bp, Homo sapiens
cccgcatgcctgcctctctgttg

SEQ ID NO: 27738 - DNA, 25 bp, Homo sapiens
tgtctgcccgcatgcctgcctctct

SEQ ID NO: 27739 - DNA, 24 bp, Homo sapiens
tgtctgcccgcatgcctgcctctc

SEQ ID NO: 27740 - DNA, 26 bp, Homo sapiens
tctgtctgcccgcatgcctgcctctc

SEQ ID NO: 27741 - DNA, 22 bp, Homo sapiens
gtctgcccgcatgcctgcctct

SEQ ID NO: 27742 - DNA, 22 bp, Homo sapiens
tgtctgcccgcatgcctgcctc

SEQ ID NO: 27743 - DNA, 24 bp, Homo sapiens
tctgtctgcccgcatgcctgcctc

SEQ ID NO: 27744 - DNA, 21 bp, Homo sapiens
tgtctgcccgcatgcctgcct

SEQ ID NO: 27745 - DNA, 19 bp, Homo sapiens
tgtctgcccgcatgcctgc

SEQ ID NO: 27746 - DNA, 18 bp, Homo sapiens
tgtctgcccgcatgcctg

SEQ ID NO: 27747 - DNA, 20 bp, Homo sapiens
aaggtattgttcagacttat

SEQ ID NO: 27748 - DNA, 21 bp, Homo sapiens
aaggtattgttcagacttatg

SEQ ID NO: 27749 - DNA, 24 bp, Homo sapiens
aaggtattgttcagacttatgatt

SEQ ID NO: 27750 - DNA, 18 bp, Homo sapiens
gtattgttcagacttatg

SEQ ID NO: 27751 - DNA, 27 bp, Homo sapiens
agcagcattgtacagggctatcaaagc

SEQ ID NO: 27752 - DNA, 25 bp, Homo sapiens
agcagcattgtacagggctatcaaa

SEQ ID NO: 27753 - DNA, 24 bp, Homo sapiens
agcagcattgtacagggctatcaa

SEQ ID NO: 27754 - DNA, 18 bp, Homo sapiens
gcattgtacagggctatc

SEQ ID NO: 27755 - DNA, 22 bp, Homo sapiens
agcagcattgtacagggctatc

SEQ ID NO: 27756 - DNA, 25 bp, Homo sapiens
gccctagtctagctgaagcttttcc

SEQ ID NO: 27757 - DNA, 25 bp, Homo sapiens
tgccctagtctagctgaagcttttc

SEQ ID NO: 27758 - DNA, 26 bp, Homo sapiens
ctgccctagtctagctgaagcttttc

SEQ ID NO: 27759 - DNA, 23 bp, Homo sapiens
tgccctagtctagctgaagcttt

SEQ ID NO: 27760 - DNA, 22 bp, Homo sapiens
tgccctagtctagctgaagctt

SEQ ID NO: 27761 - DNA, 23 bp, Homo sapiens
ctgccctagtctagctgaagctt

SEQ ID NO: 27762 - DNA, 21 bp, Homo sapiens
tgccctagtctagctgaagct

SEQ ID NO: 27763 - DNA, 23 bp, Homo sapiens
actgccctagtctagctgaagct

SEQ ID NO: 27764 - DNA, 20 bp, Homo sapiens
tgccctagtctagctgaagc

SEQ ID NO: 27765 - DNA, 21 bp, Homo sapiens
ctgccctagtctagctgaagc

SEQ ID NO: 27766 - DNA, 22 bp, Homo sapiens
actgccctagtctagctgaagc

SEQ ID NO: 27767 - DNA, 24 bp, Homo sapiens
tgactgccctagtctagctgaagc

SEQ ID NO: 27768 - DNA, 20 bp, Homo sapiens
ctgccctagtctagctgaag

SEQ ID NO: 27769 - DNA, 21 bp, Homo sapiens
tgatgactgccctagtctagc

SEQ ID NO: 27770 - DNA, 25 bp, Homo sapiens
cttcagccaggctagtgcagtctgc

SEQ ID NO: 27771 - DNA, 23 bp, Homo sapiens
ttcagccaggctagtgcagtctg

SEQ ID NO: 27772 - DNA, 21 bp, Homo sapiens
tcagccaggctagtgcagtct

SEQ ID NO: 27773 - DNA, 23 bp, Homo sapiens
cttcagccaggctagtgcagtct

SEQ ID NO: 27774 - DNA, 21 bp, Homo sapiens
ttcagccaggctagtgcagtc

SEQ ID NO: 27775 - DNA, 22 bp, Homo sapiens
cttcagccaggctagtgcagtc

SEQ ID NO: 27776 - DNA, 19 bp, Homo sapiens
tcagccaggctagtgcagt

SEQ ID NO: 27777 - DNA, 20 bp, Homo sapiens
ttcagccaggctagtgcagt

SEQ ID NO: 27778 - DNA, 21 bp, Homo sapiens
cttcagccaggctagtgcagt

SEQ ID NO: 27779 - DNA, 19 bp, Homo sapiens
ttcagccaggctagtgcag

SEQ ID NO: 27780 - DNA, 20 bp, Homo sapiens
cttcagccaggctagtgcag

SEQ ID NO: 27781 - DNA, 18 bp, Homo sapiens
cttcagccaggctagtgc

SEQ ID NO: 27782 - DNA, 19 bp, Homo sapiens
gcttcagccaggctagtgc

SEQ ID NO: 27783 - DNA, 22 bp, Homo sapiens
agggcttcagccaggctagtgc

SEQ ID NO: 27784 - DNA, 18 bp, Homo sapiens
cagatctataacttgtgt

SEQ ID NO: 27785 - DNA, 19 bp, Homo sapiens
ccagatctataacttgtgt

SEQ ID NO: 27786 - DNA, 20 bp, Homo sapiens
tccagatctataacttgtgt

SEQ ID NO: 27787 - DNA, 22 bp, Homo sapiens
aaatccagatctataacttgtg

SEQ ID NO: 27788 - DNA, 21 bp, Homo sapiens
aaatccagatctataacttgt

SEQ ID NO: 27789 - DNA, 22 bp, Homo sapiens
caaatccagatctataacttgt

SEQ ID NO: 27790 - DNA, 21 bp, Homo sapiens
caaatccagatctataacttg

SEQ ID NO: 27791 - DNA, 22 bp, Homo sapiens
gttcaaatccagatctataact

SEQ ID NO: 27792 - DNA, 20 bp, Homo sapiens
ttcaaatccagatctataac

SEQ ID NO: 27793 - DNA, 22 bp, Homo sapiens
ggttcaaatccagatctataac

SEQ ID NO: 27794 - DNA, 21 bp, Homo sapiens
tgggttcaaatccagatctat

SEQ ID NO: 27795 - DNA, 21 bp, Homo sapiens
tcaagtagtttcatgataaag

SEQ ID NO: 27796 - DNA, 23 bp, Homo sapiens
tcaagtagtttcatgataaaggg

SEQ ID NO: 27797 - DNA, 24 bp, Homo sapiens
tcaagtagtttcatgataaagggt

SEQ ID NO: 27798 - DNA, 18 bp, Homo sapiens
aagtagtttcatgataaa

SEQ ID NO: 27799 - DNA, 20 bp, Homo sapiens
aagtagtttcatgataaagg

SEQ ID NO: 27800 - DNA, 21 bp, Homo sapiens
aagtagtttcatgataaaggg

SEQ ID NO: 27801 - DNA, 22 bp, Homo sapiens
aagtagtttcatgataaagggt

SEQ ID NO: 27802 - DNA, 23 bp, Homo sapiens
aagtagtttcatgataaagggtg

SEQ ID NO: 27803 - DNA, 24 bp, Homo sapiens
aagtagtttcatgataaagggtgt

SEQ ID NO: 27804 - DNA, 25 bp, Homo sapiens
aagtagtttcatgataaagggtgta

SEQ ID NO: 27805 - DNA, 26 bp, Homo sapiens
aagtagtttcatgataaagggtgtat

SEQ ID NO: 27806 - DNA, 23 bp, Homo sapiens
agtagtttcatgataaagggtgt

SEQ ID NO: 27807 - DNA, 20 bp, Homo sapiens
aaacggtgagattttgtttt

SEQ ID NO: 27808 - DNA, 19 bp, Homo sapiens
catatgtatgtagtagtca

SEQ ID NO: 27809 - DNA, 22 bp, Homo sapiens
tgtatgtagtagtcaaaggcat

SEQ ID NO: 27810 - DNA, 22 bp, Homo sapiens
gtagtcaaaggcatttacatac

SEQ ID NO: 27811 - DNA, 23 bp, Homo sapiens
tgattatcttaactctctgaccc

SEQ ID NO: 27812 - DNA, 22 bp, Homo sapiens
tgattatcttaactctctgacc

SEQ ID NO: 27813 - DNA, 24 bp, Homo sapiens
actgattatcttaactctctgacc

SEQ ID NO: 27814 - DNA, 23 bp, Homo sapiens
actgattatcttaactctctgac

SEQ ID NO: 27815 - DNA, 21 bp, Homo sapiens
ctgattatcttaactctctga

SEQ ID NO: 27816 - DNA, 21 bp, Homo sapiens
actgattatcttaactctctg

SEQ ID NO: 27817 - DNA, 22 bp, Homo sapiens
ccgggtagagagggcagtggga

SEQ ID NO: 27818 - DNA, 17 bp, Homo sapiens
cgggtagagagggcagt

SEQ ID NO: 27819 - DNA, 18 bp, Homo sapiens
cgggtagagagggcagtg

SEQ ID NO: 27820 - DNA, 19 bp, Homo sapiens
cgggtagagagggcagtgg

SEQ ID NO: 27821 - DNA, 20 bp, Homo sapiens
cgggtagagagggcagtggg

SEQ ID NO: 27822 - DNA, 21 bp, Homo sapiens
cgggtagagagggcagtggga

SEQ ID NO: 27823 - DNA, 22 bp, Homo sapiens
cgggtagagagggcagtgggag

SEQ ID NO: 27824 - DNA, 24 bp, Homo sapiens
cgggtagagagggcagtgggaggt

SEQ ID NO: 27825 - DNA, 25 bp, Homo sapiens
cgggtagagagggcagtgggaggta

SEQ ID NO: 27826 - DNA, 26 bp, Homo sapiens
cgggtagagagggcagtgggaggtaa

SEQ ID NO: 27827 - DNA, 19 bp, Homo sapiens
ttcaccaccttctccaccc

SEQ ID NO: 27828 - DNA, 20 bp, Homo sapiens
ttcaccaccttctccaccca

SEQ ID NO: 27829 - DNA, 21 bp, Homo sapiens
ttcaccaccttctccacccag

SEQ ID NO: 27830 - DNA, 23 bp, Homo sapiens
ttcaccaccttctccacccagca

SEQ ID NO: 27831 - DNA, 24 bp, Homo sapiens
ttcaccaccttctccacccagcat

SEQ ID NO: 27832 - DNA, 25 bp, Homo sapiens
ttcaccaccttctccacccagcatg

SEQ ID NO: 27833 - DNA, 24 bp, Homo sapiens
tcaccaccttctccacccagcatg

SEQ ID NO: 27834 - DNA, 17 bp, Homo sapiens
catcttactgggcagca

SEQ ID NO: 27835 - DNA, 19 bp, Homo sapiens
catcttactgggcagcatt

SEQ ID NO: 27836 - DNA, 20 bp, Homo sapiens
catcttactgggcagcattg

SEQ ID NO: 27837 - DNA, 21 bp, Homo sapiens
catcttactgggcagcattgg

SEQ ID NO: 27838 - DNA, 23 bp, Homo sapiens
catcttactgggcagcattggat

SEQ ID NO: 27839 - DNA, 24 bp, Homo sapiens
catcttactgggcagcattggatg

SEQ ID NO: 27840 - DNA, 27 bp, Homo sapiens
catcttactgggcagcattggatggag

SEQ ID NO: 27841 - DNA, 21 bp, Homo sapiens
atcttactgggcagcattgga

SEQ ID NO: 27842 - DNA, 22 bp, Homo sapiens
atcttactgggcagcattggat

SEQ ID NO: 27843 - DNA, 23 bp, Homo sapiens
atcttactgggcagcattggatg

SEQ ID NO: 27844 - DNA, 19 bp, Homo sapiens
taatactgcctggtaatga

SEQ ID NO: 27845 - DNA, 20 bp, Homo sapiens
taatactgcctggtaatgat

SEQ ID NO: 27846 - DNA, 21 bp, Homo sapiens
taatactgcctggtaatgatg

SEQ ID NO: 27847 - DNA, 23 bp, Homo sapiens
taatactgcctggtaatgatgac

SEQ ID NO: 27848 - DNA, 24 bp, Homo sapiens
taatactgcctggtaatgatgacg

SEQ ID NO: 27849 - DNA, 23 bp, Homo sapiens
aatactgcctggtaatgatgacg

SEQ ID NO: 27850 - DNA, 23 bp, Homo sapiens
atactgcctggtaatgatgacgg

SEQ ID NO: 27851 - DNA, 18 bp, Homo sapiens
catcttaccggacagtgc

SEQ ID NO: 27852 - DNA, 19 bp, Homo sapiens
catcttaccggacagtgct

SEQ ID NO: 27853 - DNA, 20 bp, Homo sapiens
catcttaccggacagtgctg

SEQ ID NO: 27854 - DNA, 21 bp, Homo sapiens
catcttaccggacagtgctgg

SEQ ID NO: 27855 - DNA, 23 bp, Homo sapiens
catcttaccggacagtgctggat

SEQ ID NO: 27856 - DNA, 24 bp, Homo sapiens
catcttaccggacagtgctggatt

SEQ ID NO: 27857 - DNA, 26 bp, Homo sapiens
catcttaccggacagtgctggatttc

SEQ ID NO: 27858 - DNA, 27 bp, Homo sapiens
catcttaccggacagtgctggatttcc

SEQ ID NO: 27859 - DNA, 28 bp, Homo sapiens
catcttaccggacagtgctggatttccc

SEQ ID NO: 27860 - DNA, 18 bp, Homo sapiens
atcttaccggacagtgct

SEQ ID NO: 27861 - DNA, 20 bp, Homo sapiens
atcttaccggacagtgctgg

SEQ ID NO: 27862 - DNA, 22 bp, Homo sapiens
atcttaccggacagtgctggat

SEQ ID NO: 27863 - DNA, 23 bp, Homo sapiens
atcttaccggacagtgctggatt

SEQ ID NO: 27864 - DNA, 25 bp, Homo sapiens
atcttaccggacagtgctggatttc

SEQ ID NO: 27865 - DNA, 26 bp, Homo sapiens
atcttaccggacagtgctggatttcc

SEQ ID NO: 27866 - DNA, 18 bp, Homo sapiens
taacactgtctggtaacg

SEQ ID NO: 27867 - DNA, 19 bp, Homo sapiens
taacactgtctggtaacga

SEQ ID NO: 27868 - DNA, 20 bp, Homo sapiens
taacactgtctggtaacgat

SEQ ID NO: 27869 - DNA, 21 bp, Homo sapiens
taacactgtctggtaacgatg

SEQ ID NO: 27870 - DNA, 23 bp, Homo sapiens
taacactgtctggtaacgatgtt

SEQ ID NO: 27871 - DNA, 24 bp, Homo sapiens
taacactgtctggtaacgatgttc

SEQ ID NO: 27872 - DNA, 22 bp, Homo sapiens
aacactgtctggtaacgatgtt

SEQ ID NO: 27873 - DNA, 22 bp, Homo sapiens
tgagagtggaattcacagtatt

SEQ ID NO: 27874 - DNA, 17 bp, Homo sapiens
tctcgtttgatctcgga

SEQ ID NO: 27875 - DNA, 19 bp, Homo sapiens
tctcgtttgatctcggaag

SEQ ID NO: 27876 - DNA, 20 bp, Homo sapiens
tctcgtttgatctcggaagc

SEQ ID NO: 27877 - DNA, 21 bp, Homo sapiens
tctcgtttgatctcggaagct

SEQ ID NO: 27878 - DNA, 22 bp, Homo sapiens
tctcgtttgatctcggaagcta

SEQ ID NO: 27879 - DNA, 23 bp, Homo sapiens
tctcgtttgatctcggaagctaa

SEQ ID NO: 27880 - DNA, 24 bp, Homo sapiens
tctcgtttgatctcggaagctaag

SEQ ID NO: 27881 - DNA, 25 bp, Homo sapiens
tctcgtttgatctcggaagctaagc

SEQ ID NO: 27882 - DNA, 17 bp, Homo sapiens
ctcgtttgatctcggaa

SEQ ID NO: 27883 - DNA, 20 bp, Homo sapiens
ctcgtttgatctcggaagct

SEQ ID NO: 27884 - DNA, 21 bp, Homo sapiens
ctcgtttgatctcggaagcta

SEQ ID NO: 27885 - DNA, 22 bp, Homo sapiens
ctcgtttgatctcggaagctaa

SEQ ID NO: 27886 - DNA, 27 bp, Homo sapiens
ctcgtttgatctcggaagctaagcagg

SEQ ID NO: 27887 - DNA, 18 bp, Homo sapiens
tcgtttgatctcggaagc

SEQ ID NO: 27888 - DNA, 19 bp, Homo sapiens
tcgtttgatctcggaagct

SEQ ID NO: 27889 - DNA, 21 bp, Homo sapiens
tcgtttgatctcggaagctaa

SEQ ID NO: 27890 - DNA, 25 bp, Homo sapiens
tcgtttgatctcggaagctaagcag

SEQ ID NO: 27891 - DNA, 28 bp, Homo sapiens
tcgtttgatctcggaagctaagcagggt

SEQ ID NO: 27892 - DNA, 16 bp, Homo sapiens
cgtttgatctcggaag

SEQ ID NO: 27893 - DNA, 17 bp, Homo sapiens
cgtttgatctcggaagc

SEQ ID NO: 27894 - DNA, 18 bp, Homo sapiens
cgtttgatctcggaagct

SEQ ID NO: 27895 - DNA, 21 bp, Homo sapiens
cgtttgatctcggaagctaag

SEQ ID NO: 27896 - DNA, 23 bp, Homo sapiens
cgtttgatctcggaagctaagca

SEQ ID NO: 27897 - DNA, 25 bp, Homo sapiens
cgtttgatctcggaagctaagcagg

SEQ ID NO: 27898 - DNA, 27 bp, Homo sapiens
cgtttgatctcggaagctaagcagggt

SEQ ID NO: 27899 - DNA, 22 bp, Homo sapiens
ctaatactgtctggtaaaaccg

SEQ ID NO: 27900 - DNA, 23 bp, Homo sapiens
ctaatactgtctggtaaaaccgt

SEQ ID NO: 27901 - DNA, 18 bp, Homo sapiens
taatactgtctggtaaaa

SEQ ID NO: 27902 - DNA, 19 bp, Homo sapiens
taatactgtctggtaaaac

SEQ ID NO: 27903 - DNA, 20 bp, Homo sapiens
taatactgtctggtaaaacc

SEQ ID NO: 27904 - DNA, 21 bp, Homo sapiens
taatactgtctggtaaaaccg

SEQ ID NO: 27905 - DNA, 23 bp, Homo sapiens
taatactgtctggtaaaaccgtc

SEQ ID NO: 27906 - DNA, 24 bp, Homo sapiens
taatactgtctggtaaaaccgtcc

SEQ ID NO: 27907 - DNA, 26 bp, Homo sapiens
taatactgtctggtaaaaccgtccat

SEQ ID NO: 27908 - DNA, 27 bp, Homo sapiens
taatactgtctggtaaaaccgtccatc

SEQ ID NO: 27909 - DNA, 21 bp, Homo sapiens
aatactgtctggtaaaaccgt

SEQ ID NO: 27910 - DNA, 16 bp, Homo sapiens
ggtaccctaactgtgc

SEQ ID NO: 27911 - DNA, 17 bp, Homo sapiens
cggtaccctaactgtgc

SEQ ID NO: 27912 - DNA, 20 bp, Homo sapiens
ccgcggtaccctaactgtgc

SEQ ID NO: 27913 - DNA, 21 bp, Homo sapiens
gccgcggtaccctaactgtgc

SEQ ID NO: 27914 - DNA, 22 bp, Homo sapiens
ggccgcggtaccctaactgtgc

SEQ ID NO: 27915 - DNA, 23 bp, Homo sapiens
cggccgcggtaccctaactgtgc

SEQ ID NO: 27916 - DNA, 26 bp, Homo sapiens
taacggccgcggtaccctaactgtgc

SEQ ID NO: 27917 - DNA, 24 bp, Homo sapiens
aacggccgcggtaccctaactgtg

SEQ ID NO: 27918 - DNA, 25 bp, Homo sapiens
taacggccgcggtaccctaactgtg

SEQ ID NO: 27919 - DNA, 26 bp, Homo sapiens
ttaacggccgcggtaccctaactgtg

SEQ ID NO: 27920 - DNA, 17 bp, Homo sapiens
cgcggtaccctaactgt

SEQ ID NO: 27921 - DNA, 19 bp, Homo sapiens
gccgcggtaccctaactgt

SEQ ID NO: 27922 - DNA, 22 bp, Homo sapiens
acggccgcggtaccctaactgt

SEQ ID NO: 27923 - DNA, 18 bp, Homo sapiens
gccgcggtaccctaactg

SEQ ID NO: 27924 - DNA, 19 bp, Homo sapiens
ggccgcggtaccctaactg

SEQ ID NO: 27925 - DNA, 20 bp, Homo sapiens
cggccgcggtaccctaactg

SEQ ID NO: 27926 - DNA, 24 bp, Homo sapiens
ttaacggccgcggtaccctaactg

SEQ ID NO: 27927 - DNA, 25 bp, Homo sapiens
tttaacggccgcggtaccctaactg

SEQ ID NO: 27928 - DNA, 26 bp, Homo sapiens
gtttaacggccgcggtaccctaactg

SEQ ID NO: 27929 - DNA, 17 bp, Homo sapiens
gccgcggtaccctaact

SEQ ID NO: 27930 - DNA, 19 bp, Homo sapiens
cggccgcggtaccctaact

SEQ ID NO: 27931 - DNA, 20 bp, Homo sapiens
acggccgcggtaccctaact

SEQ ID NO: 27932 - DNA, 21 bp, Homo sapiens
aacggccgcggtaccctaact

SEQ ID NO: 27933 - DNA, 23 bp, Homo sapiens
ttaacggccgcggtaccctaact

SEQ ID NO: 27934 - DNA, 25 bp, Homo sapiens
gtttaacggccgcggtaccctaact

SEQ ID NO: 27935 - DNA, 23 bp, Homo sapiens
cgtttaacggccgcggtacccta

SEQ ID NO: 27936 - DNA, 25 bp, Homo sapiens
tgcgtttaacggccgcggtacccta

SEQ ID NO: 27937 - DNA, 24 bp, Homo sapiens
tgcgtttaacggccgcggtaccct

SEQ ID NO: 27938 - DNA, 22 bp, Homo sapiens
gcgtttaacggccgcggtaccc

SEQ ID NO: 27939 - DNA, 23 bp, Homo sapiens
tgcgtttaacggccgcggtaccc

SEQ ID NO: 27940 - DNA, 20 bp, Homo sapiens
cgtttaacggccgcggtacc

SEQ ID NO: 27941 - DNA, 22 bp, Homo sapiens
tgcgtttaacggccgcggtacc

SEQ ID NO: 27942 - DNA, 20 bp, Homo sapiens
attaatgtggactggtgtga

SEQ ID NO: 27943 - DNA, 24 bp, Homo sapiens
taatgtggactggtgtgaccaaaa

SEQ ID NO: 27944 - DNA, 23 bp, Homo sapiens
aatgtggactggtgtgaccaaaa

SEQ ID NO: 27945 - DNA, 26 bp, Homo sapiens
aatgtggactggtgtgaccaaaagtc

SEQ ID NO: 27946 - DNA, 24 bp, Homo sapiens
tgtggactggtgtgaccaaaagtc

SEQ ID NO: 27947 - DNA, 24 bp, Homo sapiens
taggcagtgtcattagctgattgt

SEQ ID NO: 27948 - DNA, 17 bp, Homo sapiens
aggcagtgtcattagct

SEQ ID NO: 27949 - DNA, 20 bp, Homo sapiens
aggcagtgtcattagctgat

SEQ ID NO: 27950 - DNA, 21 bp, Homo sapiens
aggcagtgtcattagctgatt

SEQ ID NO: 27951 - DNA, 22 bp, Homo sapiens
aggcagtgtcattagctgattg

SEQ ID NO: 27952 - DNA, 23 bp, Homo sapiens
aggcagtgtcattagctgattgt

SEQ ID NO: 27953 - DNA, 24 bp, Homo sapiens
aggcagtgtcattagctgattgta

SEQ ID NO: 27954 - DNA, 25 bp, Homo sapiens
aggcagtgtcattagctgattgtac

SEQ ID NO: 27955 - DNA, 17 bp, Homo sapiens
caatcactaactccact

SEQ ID NO: 27956 - DNA, 19 bp, Homo sapiens
caatcactaactccactgc

SEQ ID NO: 27957 - DNA, 21 bp, Homo sapiens
caatcactaactccactgcca

SEQ ID NO: 27958 - DNA, 23 bp, Homo sapiens
caatcactaactccactgccatc

SEQ ID NO: 27959 - DNA, 24 bp, Homo sapiens
caatcactaactccactgccatca

SEQ ID NO: 27960 - DNA, 26 bp, Homo sapiens
caatcactaactccactgccatcaaa

SEQ ID NO: 27961 - DNA, 18 bp, Homo sapiens
aatcactaactccactgc

SEQ ID NO: 27962 - DNA, 19 bp, Homo sapiens
aatcactaactccactgcc

SEQ ID NO: 27963 - DNA, 20 bp, Homo sapiens
aatcactaactccactgcca

SEQ ID NO: 27964 - DNA, 21 bp, Homo sapiens
aatcactaactccactgccat

SEQ ID NO: 27965 - DNA, 22 bp, Homo sapiens
aatcactaactccactgccatc

SEQ ID NO: 27966 - DNA, 23 bp, Homo sapiens
aatcactaactccactgccatca

SEQ ID NO: 27967 - DNA, 24 bp, Homo sapiens
aatcactaactccactgccatcaa

SEQ ID NO: 27968 - DNA, 18 bp, Homo sapiens
atcactaactccactgcc

SEQ ID NO: 27969 - DNA, 21 bp, Homo sapiens
atcactaactccactgccatc

SEQ ID NO: 27970 - DNA, 22 bp, Homo sapiens
atcactaactccactgccatca

SEQ ID NO: 27971 - DNA, 23 bp, Homo sapiens
ctaggcagtgtagttagctgatt

SEQ ID NO: 27972 - DNA, 21 bp, Homo sapiens
taggcagtgtagttagctgat

SEQ ID NO: 27973 - DNA, 22 bp, Homo sapiens
taggcagtgtagttagctgatt

SEQ ID NO: 27974 - DNA, 23 bp, Homo sapiens
taggcagtgtagttagctgattg

SEQ ID NO: 27975 - DNA, 18 bp, Homo sapiens
aggcagtgtagttagctg

SEQ ID NO: 27976 - DNA, 19 bp, Homo sapiens
aggcagtgtagttagctga

SEQ ID NO: 27977 - DNA, 20 bp, Homo sapiens
aggcagtgtagttagctgat

SEQ ID NO: 27978 - DNA, 21 bp, Homo sapiens
aggcagtgtagttagctgatt

SEQ ID NO: 27979 - DNA, 22 bp, Homo sapiens
aggcagtgtagttagctgattg

SEQ ID NO: 27980 - DNA, 24 bp, Homo sapiens
aggcagtgtagttagctgattgct

SEQ ID NO: 27981 - DNA, 22 bp, Homo sapiens
ggcagtgtagttagctgattgc

SEQ ID NO: 27982 - DNA, 17 bp, Homo sapiens
aatcactaaccacacgg

SEQ ID NO: 27983 - DNA, 19 bp, Homo sapiens
aatcactaaccacacggcc

SEQ ID NO: 27984 - DNA, 20 bp, Homo sapiens
aatcactaaccacacggcca

SEQ ID NO: 27985 - DNA, 21 bp, Homo sapiens
aatcactaaccacacggccag

SEQ ID NO: 27986 - DNA, 23 bp, Homo sapiens
aatcactaaccacacggccaggt

SEQ ID NO: 27987 - DNA, 24 bp, Homo sapiens
aatcactaaccacacggccaggta

SEQ ID NO: 27988 - DNA, 25 bp, Homo sapiens
aatcactaaccacacggccaggtaa

SEQ ID NO: 27989 - DNA, 17 bp, Homo sapiens
atcactaaccacacggc

SEQ ID NO: 27990 - DNA, 20 bp, Homo sapiens
atcactaaccacacggccag

SEQ ID NO: 27991 - DNA, 21 bp, Homo sapiens
atcactaaccacacggccagg

SEQ ID NO: 27992 - DNA, 22 bp, Homo sapiens
atcactaaccacacggccaggt

SEQ ID NO: 27993 - DNA, 23 bp, Homo sapiens
atcactaaccacacggccaggta

SEQ ID NO: 27994 - DNA, 23 bp, Homo sapiens
ccactacttcacttgtgaacatt

SEQ ID NO: 27995 - DNA, 24 bp, Homo sapiens
tcccactacttcacttgtgaacat

SEQ ID NO: 27996 - DNA, 25 bp, Homo sapiens
ctcccactacttcacttgtgaacat

SEQ ID NO: 27997 - DNA, 24 bp, Homo sapiens
ctcccactacttcacttgtgaaca

SEQ ID NO: 27998 - DNA, 22 bp, Homo sapiens
ctcccactacttcacttgtgaa

SEQ ID NO: 27999 - DNA, 21 bp, Homo sapiens
ctcccactacttcacttgtga

SEQ ID NO: 28000 - DNA, 20 bp, Homo sapiens
ctcccactacttcacttgtg

SEQ ID NO: 28001 - DNA, 21 bp, Homo sapiens
accttgggaatgggggtaagg

SEQ ID NO: 28002 - DNA, 24 bp, Homo sapiens
ccttgggaatgggggtaagggcct

SEQ ID NO: 28003 - DNA, 21 bp, Homo sapiens
cttgggaatgggggtaagggc

SEQ ID NO: 28004 - DNA, 21 bp, Homo sapiens
tgggaatgggggtaagggcct

SEQ ID NO: 28005 - DNA, 18 bp, Homo sapiens
ggggtaagggccttctga

SEQ ID NO: 28006 - DNA, 22 bp, Homo sapiens
gtccgaactctccattcctctg

SEQ ID NO: 28007 - DNA, 23 bp, Homo sapiens
gtccgaactctccattcctctgc

SEQ ID NO: 28008 - DNA, 20 bp, Homo sapiens
tccgaactctccattcctct

SEQ ID NO: 28009 - DNA, 21 bp, Homo sapiens
tccgaactctccattcctctg

SEQ ID NO: 28010 - DNA, 23 bp, Homo sapiens
tccgaactctccattcctctgca

SEQ ID NO: 28011 - DNA, 24 bp, Homo sapiens
tccgaactctccattcctctgcag

SEQ ID NO: 28012 - DNA, 25 bp, Homo sapiens
tccgaactctccattcctctgcaga

SEQ ID NO: 28013 - DNA, 27 bp, Homo sapiens
tccgaactctccattcctctgcagagc

SEQ ID NO: 28014 - DNA, 22 bp, Homo sapiens
ccgaactctccattcctctgca

SEQ ID NO: 28015 - DNA, 23 bp, Homo sapiens
ccgaactctccattcctctgcag

SEQ ID NO: 28016 - DNA, 26 bp, Homo sapiens
ccgaactctccattcctctgcagagc

SEQ ID NO: 28017 - DNA, 18 bp, Homo sapiens
aggggctgggcgcgcgcc

SEQ ID NO: 28018 - DNA, 23 bp, Homo sapiens
aggggctgggcgcgcgccagccg

SEQ ID NO: 28019 - DNA, 18 bp, Homo sapiens
ggggctgggcgcgcgcca

SEQ ID NO: 28020 - DNA, 19 bp, Homo sapiens
ggggctgggcgcgcgccag

SEQ ID NO: 28021 - DNA, 20 bp, Homo sapiens
ggggctgggcgcgcgccagc

SEQ ID NO: 28022 - DNA, 22 bp, Homo sapiens
ggggctgggcgcgcgccagccg

SEQ ID NO: 28023 - DNA, 17 bp, Homo sapiens
gggctgggcgcgcgcca

SEQ ID NO: 28024 - DNA, 19 bp, Homo sapiens
gggctgggcgcgcgccagc

SEQ ID NO: 28025 - DNA, 21 bp, Homo sapiens
gggctgggcgcgcgccagccg

SEQ ID NO: 28026 - DNA, 16 bp, Homo sapiens
ggctgggcgcgcgcca

SEQ ID NO: 28027 - DNA, 18 bp, Homo sapiens
ggctgggcgcgcgccagc

SEQ ID NO: 28028 - DNA, 19 bp, Homo sapiens
ggctgggcgcgcgccagcc

SEQ ID NO: 28029 - DNA, 20 bp, Homo sapiens
ggctgggcgcgcgccagccg

SEQ ID NO: 28030 - DNA, 21 bp, Homo sapiens
ggctgggcgcgcgccagccgg

SEQ ID NO: 28031 - DNA, 17 bp, Homo sapiens
gctgggcgcgcgccagc

SEQ ID NO: 28032 - DNA, 18 bp, Homo sapiens
ctgggcgcgcgccagccg

SEQ ID NO: 28033 - DNA, 19 bp, Homo sapiens
gcccgtggcgggtgcgggg

SEQ ID NO: 28034 - DNA, 16 bp, Homo sapiens
tggcgggtgcgggggt

SEQ ID NO: 28035 - DNA, 17 bp, Homo sapiens
tggcgggtgcgggggtg

SEQ ID NO: 28036 - DNA, 19 bp, Homo sapiens
tggcgggtgcgggggtggg

SEQ ID NO: 28037 - DNA, 21 bp, Homo sapiens
tggcgggtgcgggggtgggag

SEQ ID NO: 28038 - DNA, 23 bp, Homo sapiens
tggcgggtgcgggggtgggaggg

SEQ ID NO: 28039 - DNA, 24 bp, Homo sapiens
tggcgggtgcgggggtgggagggc

SEQ ID NO: 28040 - DNA, 21 bp, Homo sapiens
ggcgggtgcgggggtgggagg

SEQ ID NO: 28041 - DNA, 22 bp, Homo sapiens
ggcgggtgcgggggtgggaggg

SEQ ID NO: 28042 - DNA, 23 bp, Homo sapiens
ggcgggtgcgggggtgggagggc

SEQ ID NO: 28043 - DNA, 21 bp, Homo sapiens
gcgggtgcgggggtgggaggg

SEQ ID NO: 28044 - DNA, 22 bp, Homo sapiens
gcgggtgcgggggtgggagggc

SEQ ID NO: 28045 - DNA, 20 bp, Homo sapiens
cgggtgcgggggtgggaggg

SEQ ID NO: 28046 - DNA, 21 bp, Homo sapiens
cgggtgcgggggtgggagggc

SEQ ID NO: 28047 - DNA, 23 bp, Homo sapiens
tccccttcctccctgcccagggg

SEQ ID NO: 28048 - DNA, 22 bp, Homo sapiens
tccccttcctccctgcccaggg

SEQ ID NO: 28049 - DNA, 23 bp, Homo sapiens
ctccccttcctccctgcccaggg

SEQ ID NO: 28050 - DNA, 22 bp, Homo sapiens
ctccccttcctccctgcccagg

SEQ ID NO: 28051 - DNA, 23 bp, Homo sapiens
cctccccttcctccctgcccagg

SEQ ID NO: 28052 - DNA, 21 bp, Homo sapiens
ctccccttcctccctgcccag

SEQ ID NO: 28053 - DNA, 25 bp, Homo sapiens
tggggctggaggtggggctgaggct

SEQ ID NO: 28054 - DNA, 24 bp, Homo sapiens
tggggctggaggtggggctgaggc

SEQ ID NO: 28055 - DNA, 23 bp, Homo sapiens
tggggctggaggtggggctgagg

SEQ ID NO: 28056 - DNA, 28 bp, Homo sapiens
tagggtggggctggaggtggggctgagg

SEQ ID NO: 28057 - DNA, 24 bp, Homo sapiens
tagggtggggctggaggtggggct

SEQ ID NO: 28058 - DNA, 25 bp, Homo sapiens
acgggttaggctcttgggagctgcg

SEQ ID NO: 28059 - DNA, 23 bp, Homo sapiens
cgggttaggctcttgggagctgc

SEQ ID NO: 28060 - DNA, 24 bp, Homo sapiens
acgggttaggctcttgggagctgc

SEQ ID NO: 28061 - DNA, 23 bp, Homo sapiens
acgggttaggctcttgggagctg

SEQ ID NO: 28062 - DNA, 21 bp, Homo sapiens
acgggttaggctcttgggagc

SEQ ID NO: 28063 - DNA, 22 bp, Homo sapiens
cacgggttaggctcttgggagc

SEQ ID NO: 28064 - DNA, 24 bp, Homo sapiens
tccacgggttaggctcttgggagc

SEQ ID NO: 28065 - DNA, 20 bp, Homo sapiens
acgggttaggctcttgggag

SEQ ID NO: 28066 - DNA, 21 bp, Homo sapiens
cacgggttaggctcttgggag

SEQ ID NO: 28067 - DNA, 23 bp, Homo sapiens
tccacgggttaggctcttgggag

SEQ ID NO: 28068 - DNA, 19 bp, Homo sapiens
acgggttaggctcttggga

SEQ ID NO: 28069 - DNA, 17 bp, Homo sapiens
acgggttaggctcttgg

SEQ ID NO: 28070 - DNA, 20 bp, Homo sapiens
tccacgggttaggctcttgg

SEQ ID NO: 28071 - DNA, 16 bp, Homo sapiens
acgggttaggctcttg

SEQ ID NO: 28072 - DNA, 27 bp, Homo sapiens
tccctgagaccctaacttgtgatgttt

SEQ ID NO: 28073 - DNA, 26 bp, Homo sapiens
tccctgagaccctaacttgtgatgtt

SEQ ID NO: 28074 - DNA, 25 bp, Homo sapiens
tccctgagaccctaacttgtgatgt

SEQ ID NO: 28075 - DNA, 22 bp, Homo sapiens
cctgagaccctaacttgtgatg

SEQ ID NO: 28076 - DNA, 23 bp, Homo sapiens
ccctgagaccctaacttgtgatg

SEQ ID NO: 28077 - DNA, 24 bp, Homo sapiens
tccctgagaccctaacttgtgatg

SEQ ID NO: 28078 - DNA, 21 bp, Homo sapiens
cctgagaccctaacttgtgat

SEQ ID NO: 28079 - DNA, 22 bp, Homo sapiens
ccctgagaccctaacttgtgat

SEQ ID NO: 28080 - DNA, 23 bp, Homo sapiens
tccctgagaccctaacttgtgat

SEQ ID NO: 28081 - DNA, 21 bp, Homo sapiens
ccctgagaccctaacttgtga

SEQ ID NO: 28082 - DNA, 25 bp, Homo sapiens
cagtccctgagaccctaacttgtga

SEQ ID NO: 28083 - DNA, 21 bp, Homo sapiens
tccctgagaccctaacttgtg

SEQ ID NO: 28084 - DNA, 28 bp, Homo sapiens
ctgtacagcctcctagctttccttgggt

SEQ ID NO: 28085 - DNA, 27 bp, Homo sapiens
ctgtacagcctcctagctttccttggg

SEQ ID NO: 28086 - DNA, 25 bp, Homo sapiens
ctgtacagcctcctagctttccttg

SEQ ID NO: 28087 - DNA, 24 bp, Homo sapiens
ctgtacagcctcctagctttcctt

SEQ ID NO: 28088 - DNA, 23 bp, Homo sapiens
ctgtacagcctcctagctttcct

SEQ ID NO: 28089 - DNA, 21 bp, Homo sapiens
ctgtacagcctcctagctttc

SEQ ID NO: 28090 - DNA, 22 bp, Homo sapiens
actgtacagcctcctagctttc

SEQ ID NO: 28091 - DNA, 20 bp, Homo sapiens
ctgtacagcctcctagcttt

SEQ ID NO: 28092 - DNA, 21 bp, Homo sapiens
actgtacagcctcctagcttt

SEQ ID NO: 28093 - DNA, 27 bp, Homo sapiens
tgaggtagtaggttgtatagtttagaa

SEQ ID NO: 28094 - DNA, 26 bp, Homo sapiens
tgaggtagtaggttgtatagtttaga

SEQ ID NO: 28095 - DNA, 21 bp, Homo sapiens
gtagtaggttgtatagtttag

SEQ ID NO: 28096 - DNA, 25 bp, Homo sapiens
tgaggtagtaggttgtatagtttag

SEQ ID NO: 28097 - DNA, 21 bp, Homo sapiens
ggtagtaggttgtatagttta

SEQ ID NO: 28098 - DNA, 23 bp, Homo sapiens
gaggtagtaggttgtatagttta

SEQ ID NO: 28099 - DNA, 24 bp, Homo sapiens
tgaggtagtaggttgtatagttta

SEQ ID NO: 28100 - DNA, 23 bp, Homo sapiens
ttgaggtagtaggttgtatagtt

SEQ ID NO: 28101 - DNA, 21 bp, Homo sapiens
tgaggtagtaggttgtatagt

SEQ ID NO: 28102 - DNA, 22 bp, Homo sapiens
ttgaggtagtaggttgtatagt

SEQ ID NO: 28103 - DNA, 21 bp, Homo sapiens
ttgaggtagtaggttgtatag

SEQ ID NO: 28104 - DNA, 18 bp, Homo sapiens
tgaggtagtaggttgtat

SEQ ID NO: 28105 - DNA, 26 bp, Homo sapiens
caagcttgtatctataggtatgtgtc

SEQ ID NO: 28106 - DNA, 20 bp, Homo sapiens
cttgtatctataggtatgtg

SEQ ID NO: 28107 - DNA, 24 bp, Homo sapiens
caagcttgtatctataggtatgtg

SEQ ID NO: 28108 - DNA, 23 bp, Homo sapiens
caagcttgtatctataggtatgt

SEQ ID NO: 28109 - DNA, 20 bp, Homo sapiens
aagcttgtatctataggtat

SEQ ID NO: 28110 - DNA, 21 bp, Homo sapiens
caagcttgtatctataggtat

SEQ ID NO: 28111 - DNA, 20 bp, Homo sapiens
caagcttgtatctataggta

SEQ ID NO: 28112 - DNA, 19 bp, Homo sapiens
caagcttgtatctataggt

SEQ ID NO: 28113 - DNA, 18 bp, Homo sapiens
caagcttgtatctatagg

SEQ ID NO: 28114 - DNA, 24 bp, Homo sapiens
aacccgtagatccgaacttgtggt

SEQ ID NO: 28115 - DNA, 23 bp, Homo sapiens
aacccgtagatccgaacttgtgg

SEQ ID NO: 28116 - DNA, 21 bp, Homo sapiens
aacccgtagatccgaacttgt

SEQ ID NO: 28117 - DNA, 20 bp, Homo sapiens
aacccgtagatccgaacttg

SEQ ID NO: 28118 - DNA, 19 bp, Homo sapiens
aacccgtagatccgaactt

SEQ ID NO: 28119 - DNA, 20 bp, Homo sapiens
aggcctttccatctctgtct

SEQ ID NO: 28120 - DNA, 23 bp, Homo sapiens
agaaggcctttccatctctgtct

SEQ ID NO: 28121 - DNA, 22 bp, Homo sapiens
agaaggcctttccatctctgtc

SEQ ID NO: 28122 - DNA, 22 bp, Homo sapiens
cagaaggcctttccatctctgt

SEQ ID NO: 28123 - DNA, 24 bp, Homo sapiens
tccagaaggcctttccatctctgt

SEQ ID NO: 28124 - DNA, 21 bp, Homo sapiens
cagaaggcctttccatctctg

SEQ ID NO: 28125 - DNA, 23 bp, Homo sapiens
tttcagaaatactggtgtcccga

SEQ ID NO: 28126 - DNA, 25 bp, Homo sapiens
gatttcagaaatactggtgtcccga

SEQ ID NO: 28127 - DNA, 21 bp, Homo sapiens
ttcagaaatactggtgtcccg

SEQ ID NO: 28128 - DNA, 23 bp, Homo sapiens
atttcagaaatactggtgtcccg

SEQ ID NO: 28129 - DNA, 22 bp, Homo sapiens
gatttcagaaatactggtgtcc

SEQ ID NO: 28130 - DNA, 24 bp, Homo sapiens
aaggatttcagaaatactggtgtc

SEQ ID NO: 28131 - DNA, 21 bp, Homo sapiens
ggatttcagaaatactggtgt

SEQ ID NO: 28132 - DNA, 23 bp, Homo sapiens
aaggatttcagaaatactggtgt

SEQ ID NO: 28133 - DNA, 23 bp, Homo sapiens
gaaggatttcagaaatactggtg

SEQ ID NO: 28134 - DNA, 19 bp, Homo sapiens
cacgtggatgacagtggag

SEQ ID NO: 28135 - DNA, 18 bp, Homo sapiens
acgtggatgacagtggag

SEQ ID NO: 28136 - DNA, 20 bp, Homo sapiens
acgtggatgacagtggaggc

SEQ ID NO: 28137 - DNA, 22 bp, Homo sapiens
acgtggatgacagtggaggcct

SEQ ID NO: 28138 - DNA, 19 bp, Homo sapiens
cgtggatgacagtggaggc

SEQ ID NO: 28139 - DNA, 20 bp, Homo sapiens
cgtggatgacagtggaggcc

SEQ ID NO: 28140 - DNA, 21 bp, Homo sapiens
cgtggatgacagtggaggcct

SEQ ID NO: 28141 - DNA, 22 bp, Homo sapiens
cgtggatgacagtggaggcctc

SEQ ID NO: 28142 - DNA, 24 bp, Homo sapiens
cgtggatgacagtggaggcctcct

SEQ ID NO: 28143 - DNA, 25 bp, Homo sapiens
cgtggatgacagtggaggcctcctg

SEQ ID NO: 28144 - DNA, 18 bp, Homo sapiens
tggatgacagtggaggcc

SEQ ID NO: 28145 - DNA, 20 bp, Homo sapiens
tggatgacagtggaggcctc

SEQ ID NO: 28146 - DNA, 22 bp, Homo sapiens
tggatgacagtggaggcctcct

SEQ ID NO: 28147 - DNA, 23 bp, Homo sapiens
tggatgacagtggaggcctcctg

SEQ ID NO: 28148 - DNA, 24 bp, Homo sapiens
tggatgacagtggaggcctcctgg

SEQ ID NO: 28149 - DNA, 25 bp, Homo sapiens
tggatgacagtggaggcctcctgga

SEQ ID NO: 28150 - DNA, 21 bp, Homo sapiens
agggcctctcttgtcatcctg

SEQ ID NO: 28151 - DNA, 23 bp, Homo sapiens
agggcctctcttgtcatcctgca

SEQ ID NO: 28152 - DNA, 24 bp, Homo sapiens
agggcctctcttgtcatcctgcag

SEQ ID NO: 28153 - DNA, 20 bp, Homo sapiens
gggcctctcttgtcatcctg

SEQ ID NO: 28154 - DNA, 22 bp, Homo sapiens
gggcctctcttgtcatcctgca

SEQ ID NO: 28155 - DNA, 24 bp, Homo sapiens
ttatctgacctgatgaaggtctcc

SEQ ID NO: 28156 - DNA, 21 bp, Homo sapiens
atctgacctgatgaaggtctc

SEQ ID NO: 28157 - DNA, 22 bp, Homo sapiens
tatctgacctgatgaaggtctc

SEQ ID NO: 28158 - DNA, 23 bp, Homo sapiens
ttatctgacctgatgaaggtctc

SEQ ID NO: 28159 - DNA, 22 bp, Homo sapiens
ttatctgacctgatgaaggtct

SEQ ID NO: 28160 - DNA, 21 bp, Homo sapiens
ttatctgacctgatgaaggtc

SEQ ID NO: 28161 - DNA, 20 bp, Homo sapiens
ttatctgacctgatgaaggt

SEQ ID NO: 28162 - DNA, 19 bp, Homo sapiens
ttatctgacctgatgaagg

SEQ ID NO: 28163 - DNA, 18 bp, Homo sapiens
ttatctgacctgatgaag

SEQ ID NO: 28164 - DNA, 17 bp, Homo sapiens
ttatctgacctgatgaa

SEQ ID NO: 28165 - DNA, 24 bp, Homo sapiens
gtgactcctgccccttggtcttca

SEQ ID NO: 28166 - DNA, 25 bp, Homo sapiens
tgtcagtgactcctgccccttggtc

SEQ ID NO: 28167 - DNA, 23 bp, Homo sapiens
gtcagtgactcctgccccttggt

SEQ ID NO: 28168 - DNA, 23 bp, Homo sapiens
tgtcagtgactcctgccccttgg

SEQ ID NO: 28169 - DNA, 22 bp, Homo sapiens
tgtcagtgactcctgccccttg

SEQ ID NO: 28170 - DNA, 21 bp, Homo sapiens
tgtcagtgactcctgcccctt

SEQ ID NO: 28171 - DNA, 22 bp, Homo sapiens
cgcagtcactgacgtgaaggga

SEQ ID NO: 28172 - DNA, 27 bp, Homo sapiens
gaagggggcgcagtcactgacgtgaag

SEQ ID NO: 28173 - DNA, 21 bp, Homo sapiens
agggggcgcagtcactgacgt

SEQ ID NO: 28174 - DNA, 22 bp, Homo sapiens
ggtagtgagttatcagctacag

SEQ ID NO: 28175 - DNA, 19 bp, Homo sapiens
tagtgagttatcagctaca

SEQ ID NO: 28176 - DNA, 22 bp, Homo sapiens
accggcaattacttttgcacta

SEQ ID NO: 28177 - DNA, 23 bp, Homo sapiens
aaaccggcaattacttttgcact

SEQ ID NO: 28178 - DNA, 22 bp, Homo sapiens
aaaaccggcaattacttttgca

SEQ ID NO: 28179 - DNA, 23 bp, Homo sapiens
aaaaaccggcaattacttttgca

SEQ ID NO: 28180 - DNA, 24 bp, Homo sapiens
caaaaaccggcaattacttttgca

SEQ ID NO: 28181 - DNA, 22 bp, Homo sapiens
aaaaaccggcaattacttttgc

SEQ ID NO: 28182 - DNA, 23 bp, Homo sapiens
caaaaaccggcaattacttttgc

SEQ ID NO: 28183 - DNA, 21 bp, Homo sapiens
aaaaaccggcaattacttttg

SEQ ID NO: 28184 - DNA, 21 bp, Homo sapiens
caaaaaccggcaattactttt

SEQ ID NO: 28185 - DNA, 23 bp, Homo sapiens
ggcaaaaaccggcaattactttt

SEQ ID NO: 28186 - DNA, 25 bp, Homo sapiens
gaaaagctgggttgagagggcaaac

SEQ ID NO: 28187 - DNA, 24 bp, Homo sapiens
aaaagctgggttgagagggcaaac

SEQ ID NO: 28188 - DNA, 25 bp, Homo sapiens
aaaagctgggttgagagggcaaaca

SEQ ID NO: 28189 - DNA, 26 bp, Homo sapiens
aaaagctgggttgagagggcaaacaa

SEQ ID NO: 28190 - DNA, 27 bp, Homo sapiens
aaaagctgggttgagagggcaaacaaa

SEQ ID NO: 28191 - DNA, 28 bp, Homo sapiens
aaaagctgggttgagagggcaaacaaat

SEQ ID NO: 28192 - DNA, 23 bp, Homo sapiens
aaagctgggttgagagggcaaac

SEQ ID NO: 28193 - DNA, 24 bp, Homo sapiens
aaagctgggttgagagggcaaaca

SEQ ID NO: 28194 - DNA, 26 bp, Homo sapiens
aaagctgggttgagagggcaaacaaa

SEQ ID NO: 28195 - DNA, 22 bp, Homo sapiens
aagctgggttgagagggcaaac

SEQ ID NO: 28196 - DNA, 25 bp, Homo sapiens
aagctgggttgagagggcaaacaaa

SEQ ID NO: 28197 - DNA, 18 bp, Homo sapiens
tcttctctgttttggcca

SEQ ID NO: 28198 - DNA, 19 bp, Homo sapiens
tcttctctgttttggccat

SEQ ID NO: 28199 - DNA, 20 bp, Homo sapiens
tcttctctgttttggccatg

SEQ ID NO: 28200 - DNA, 21 bp, Homo sapiens
tcttctctgttttggccatgt

SEQ ID NO: 28201 - DNA, 23 bp, Homo sapiens
tcttctctgttttggccatgtgt

SEQ ID NO: 28202 - DNA, 24 bp, Homo sapiens
tcttctctgttttggccatgtgtg

SEQ ID NO: 28203 - DNA, 22 bp, Homo sapiens
cttctctgttttggccatgtgt

SEQ ID NO: 28204 - DNA, 21 bp, Homo sapiens
ttctctgttttggccatgtgt

SEQ ID NO: 28205 - DNA, 22 bp, Homo sapiens
ttctctgttttggccatgtgtg

SEQ ID NO: 28206 - DNA, 23 bp, Homo sapiens
ttctctgttttggccatgtgtgt

SEQ ID NO: 28207 - DNA, 21 bp, Homo sapiens
tctctgttttggccatgtgtg

SEQ ID NO: 28208 - DNA, 22 bp, Homo sapiens
acacatggccgaaacagagaag

SEQ ID NO: 28209 - DNA, 23 bp, Homo sapiens
acacatggccgaaacagagaagt

SEQ ID NO: 28210 - DNA, 19 bp, Homo sapiens
cacatggccgaaacagaga

SEQ ID NO: 28211 - DNA, 20 bp, Homo sapiens
cacatggccgaaacagagaa

SEQ ID NO: 28212 - DNA, 21 bp, Homo sapiens
cacatggccgaaacagagaag

SEQ ID NO: 28213 - DNA, 23 bp, Homo sapiens
cacatggccgaaacagagaagtt

SEQ ID NO: 28214 - DNA, 24 bp, Homo sapiens
cacatggccgaaacagagaagtta

SEQ ID NO: 28215 - DNA, 25 bp, Homo sapiens
cacatggccgaaacagagaagttac

SEQ ID NO: 28216 - DNA, 20 bp, Homo sapiens
acatggccgaaacagagaag

SEQ ID NO: 28217 - DNA, 23 bp, Homo sapiens
acatggccgaaacagagaagtta

SEQ ID NO: 28218 - DNA, 20 bp, Homo sapiens
catggccgaaacagagaagt

SEQ ID NO: 28219 - DNA, 21 bp, Homo sapiens
catggccgaaacagagaagtt

SEQ ID NO: 28220 - DNA, 22 bp, Homo sapiens
catggccgaaacagagaagtta

SEQ ID NO: 28221 - DNA, 21 bp, Homo sapiens
atggccgaaacagagaagtta

SEQ ID NO: 28222 - DNA, 22 bp, Homo sapiens
ggccgaaacagagaagttactt

SEQ ID NO: 28223 - DNA, 23 bp, Homo sapiens
tcctaggattacaagtgtcggcc

SEQ ID NO: 28224 - DNA, 19 bp, Homo sapiens
taggattacaagtgtcggc

SEQ ID NO: 28225 - DNA, 20 bp, Homo sapiens
taggattacaagtgtcggcc

SEQ ID NO: 28226 - DNA, 21 bp, Homo sapiens
taggattacaagtgtcggcca

SEQ ID NO: 28227 - DNA, 23 bp, Homo sapiens
taggattacaagtgtcggccacg

SEQ ID NO: 28228 - DNA, 24 bp, Homo sapiens
taggattacaagtgtcggccacgg

SEQ ID NO: 28229 - DNA, 25 bp, Homo sapiens
taggattacaagtgtcggccacggg

SEQ ID NO: 28230 - DNA, 19 bp, Homo sapiens
aggattacaagtgtcggcc

SEQ ID NO: 28231 - DNA, 21 bp, Homo sapiens
aggattacaagtgtcggccac

SEQ ID NO: 28232 - DNA, 20 bp, Homo sapiens
ggattacaagtgtcggccac

SEQ ID NO: 28233 - DNA, 16 bp, Homo sapiens
gtggagcgtggaggac

SEQ ID NO: 28234 - DNA, 17 bp, Homo sapiens
gtggagcgtggaggacg

SEQ ID NO: 28235 - DNA, 20 bp, Homo sapiens
gtggagcgtggaggacgagg

SEQ ID NO: 28236 - DNA, 27 bp, Homo sapiens
gtggagcgtggaggacgaggaggaggc

SEQ ID NO: 28237 - DNA, 19 bp, Homo sapiens
cgtggaggacgaggaggag

SEQ ID NO: 28238 - DNA, 20 bp, Homo sapiens
cgtggaggacgaggaggagg

SEQ ID NO: 28239 - DNA, 22 bp, Homo sapiens
cgtggaggacgaggaggaggcc

SEQ ID NO: 28240 - DNA, 25 bp, Homo sapiens
tggaggacgaggaggaggccgtcca

SEQ ID NO: 28241 - DNA, 22 bp, Homo sapiens
aggacgaggaggaggccgtcca

SEQ ID NO: 28242 - DNA, 20 bp, Homo sapiens
gacgaggaggaggccgtcca

SEQ ID NO: 28243 - DNA, 16 bp, Homo sapiens
aggaggaggccgtcca

SEQ ID NO: 28244 - DNA, 25 bp, Homo sapiens
aaatggacaggataacacctatgta

SEQ ID NO: 28245 - DNA, 24 bp, Homo sapiens
caaatggacaggataacacctatg

SEQ ID NO: 28246 - DNA, 20 bp, Homo sapiens
acataggtgttatcctatcc

SEQ ID NO: 28247 - DNA, 22 bp, Homo sapiens
atacataggtgttatcctatcc

SEQ ID NO: 28248 - DNA, 23 bp, Homo sapiens
tgtatgccctcaccgctcagccc

SEQ ID NO: 28249 - DNA, 24 bp, Homo sapiens
ctgtatgccctcaccgctcagccc

SEQ ID NO: 28250 - DNA, 22 bp, Homo sapiens
tgtatgccctcaccgctcagcc

SEQ ID NO: 28251 - DNA, 23 bp, Homo sapiens
ctgtatgccctcaccgctcagcc

SEQ ID NO: 28252 - DNA, 21 bp, Homo sapiens
tgtatgccctcaccgctcagc

SEQ ID NO: 28253 - DNA, 22 bp, Homo sapiens
ctgtatgccctcaccgctcagc

SEQ ID NO: 28254 - DNA, 20 bp, Homo sapiens
tgtatgccctcaccgctcag

SEQ ID NO: 28255 - DNA, 21 bp, Homo sapiens
ctgtatgccctcaccgctcag

SEQ ID NO: 28256 - DNA, 19 bp, Homo sapiens
ctgtatgccctcaccgctc

SEQ ID NO: 28257 - DNA, 18 bp, Homo sapiens
ctgtatgccctcaccgct

SEQ ID NO: 28258 - DNA, 21 bp, Homo sapiens
acgctgtatgccctcaccgct

SEQ ID NO: 28259 - DNA, 26 bp, Homo sapiens
tggtgcggagagggcccacagtggac

SEQ ID NO: 28260 - DNA, 25 bp, Homo sapiens
tggtgcggagagggcccacagtgga

SEQ ID NO: 28261 - DNA, 20 bp, Homo sapiens
gcggagagggcccacagtgg

SEQ ID NO: 28262 - DNA, 23 bp, Homo sapiens
ggtgcggagagggcccacagtgg

SEQ ID NO: 28263 - DNA, 24 bp, Homo sapiens
tggtgcggagagggcccacagtgg

SEQ ID NO: 28264 - DNA, 22 bp, Homo sapiens
ggtgcggagagggcccacagtg

SEQ ID NO: 28265 - DNA, 22 bp, Homo sapiens
tggtgcggagagggcccacagt

SEQ ID NO: 28266 - DNA, 21 bp, Homo sapiens
tggtgcggagagggcccacag

SEQ ID NO: 28267 - DNA, 22 bp, Homo sapiens
ctggtgcggagagggcccacag

SEQ ID NO: 28268 - DNA, 19 bp, Homo sapiens
ggtgcggagagggcccaca

SEQ ID NO: 28269 - DNA, 20 bp, Homo sapiens
tggtgcggagagggcccaca

SEQ ID NO: 28270 - DNA, 19 bp, Homo sapiens
tggtgcggagagggcccac

SEQ ID NO: 28271 - DNA, 18 bp, Homo sapiens
tggtgcggagagggccca

SEQ ID NO: 28272 - DNA, 16 bp, Homo sapiens
ggtgcggagagggccc

SEQ ID NO: 28273 - DNA, 18 bp, Homo sapiens
agggtctggtgcggagag

SEQ ID NO: 28274 - DNA, 23 bp, Homo sapiens
agggtgggcgagggcggctgagc

SEQ ID NO: 28275 - DNA, 18 bp, Homo sapiens
tgggcgagggcggctgag

SEQ ID NO: 28276 - DNA, 19 bp, Homo sapiens
tgggcgagggcggctgagc

SEQ ID NO: 28277 - DNA, 21 bp, Homo sapiens
tgggcgagggcggctgagcgg

SEQ ID NO: 28278 - DNA, 23 bp, Homo sapiens
tgggcgagggcggctgagcggct

SEQ ID NO: 28279 - DNA, 24 bp, Homo sapiens
tgggcgagggcggctgagcggctc

SEQ ID NO: 28280 - DNA, 25 bp, Homo sapiens
tgggcgagggcggctgagcggctcc

SEQ ID NO: 28281 - DNA, 27 bp, Homo sapiens
tgggcgagggcggctgagcggctccat

SEQ ID NO: 28282 - DNA, 21 bp, Homo sapiens
gcctgctcatccccctcgccc

SEQ ID NO: 28283 - DNA, 26 bp, Homo sapiens
gcctgctcatccccctcgccctctca

SEQ ID NO: 28284 - DNA, 21 bp, Homo sapiens
cctgctcatccccctcgccct

SEQ ID NO: 28285 - DNA, 22 bp, Homo sapiens
cctgctcatccccctcgccctc

SEQ ID NO: 28286 - DNA, 23 bp, Homo sapiens
ctcatccccctcgccctctcaga

SEQ ID NO: 28287 - DNA, 22 bp, Homo sapiens
tcatccccctcgccctctcaga

SEQ ID NO: 28288 - DNA, 23 bp, Homo sapiens
tcatccccctcgccctctcagac

SEQ ID NO: 28289 - DNA, 24 bp, Homo sapiens
tcatccccctcgccctctcagacc

SEQ ID NO: 28290 - DNA, 20 bp, Homo sapiens
catccccctcgccctctcag

SEQ ID NO: 28291 - DNA, 20 bp, Homo sapiens
aaggggcagggacgggtggc

SEQ ID NO: 28292 - DNA, 25 bp, Homo sapiens
aaggggcagggacgggtggccccag

SEQ ID NO: 28293 - DNA, 27 bp, Homo sapiens
aaggggcagggacgggtggccccagga

SEQ ID NO: 28294 - DNA, 21 bp, Homo sapiens
aggggcagggacgggtggccc

SEQ ID NO: 28295 - DNA, 23 bp, Homo sapiens
aggggcagggacgggtggcccca

SEQ ID NO: 28296 - DNA, 24 bp, Homo sapiens
aggggcagggacgggtggccccag

SEQ ID NO: 28297 - DNA, 25 bp, Homo sapiens
aggggcagggacgggtggccccagg

SEQ ID NO: 28298 - DNA, 20 bp, Homo sapiens
ggggcagggacgggtggccc

SEQ ID NO: 28299 - DNA, 22 bp, Homo sapiens
ggggcagggacgggtggcccca

SEQ ID NO: 28300 - DNA, 23 bp, Homo sapiens
ggggcagggacgggtggccccag

SEQ ID NO: 28301 - DNA, 24 bp, Homo sapiens
ggggcagggacgggtggccccagg

SEQ ID NO: 28302 - DNA, 22 bp, Homo sapiens
gcagggacgggtggccccagga

SEQ ID NO: 28303 - DNA, 19 bp, Homo sapiens
ggacgggtggccccaggaa

SEQ ID NO: 28304 - DNA, 26 bp, Homo sapiens
tggagccgctcttctccctgcccaca

SEQ ID NO: 28305 - DNA, 16 bp, Homo sapiens
gagccgctcttctccc

SEQ ID NO: 28306 - DNA, 19 bp, Homo sapiens
gagccgctcttctccctgc

SEQ ID NO: 28307 - DNA, 20 bp, Homo sapiens
gagccgctcttctccctgcc

SEQ ID NO: 28308 - DNA, 21 bp, Homo sapiens
gagccgctcttctccctgccc

SEQ ID NO: 28309 - DNA, 22 bp, Homo sapiens
gagccgctcttctccctgccca

SEQ ID NO: 28310 - DNA, 23 bp, Homo sapiens
gagccgctcttctccctgcccac

SEQ ID NO: 28311 - DNA, 24 bp, Homo sapiens
gagccgctcttctccctgcccaca

SEQ ID NO: 28312 - DNA, 20 bp, Homo sapiens
agccgctcttctccctgccc

SEQ ID NO: 28313 - DNA, 22 bp, Homo sapiens
agccgctcttctccctgcccac

SEQ ID NO: 28314 - DNA, 24 bp, Homo sapiens
agccgctcttctccctgcccacag

SEQ ID NO: 28315 - DNA, 25 bp, Homo sapiens
agccgctcttctccctgcccacaga

SEQ ID NO: 28316 - DNA, 26 bp, Homo sapiens
cactcctctcctcccgtcttctcctc

SEQ ID NO: 28317 - DNA, 27 bp, Homo sapiens
tcactcctctcctcccgtcttctcctc

SEQ ID NO: 28318 - DNA, 24 bp, Homo sapiens
cactcctctcctcccgtcttctcc

SEQ ID NO: 28319 - DNA, 23 bp, Homo sapiens
cactcctctcctcccgtcttctc

SEQ ID NO: 28320 - DNA, 24 bp, Homo sapiens
tcactcctctcctcccgtcttctc

SEQ ID NO: 28321 - DNA, 23 bp, Homo sapiens
tcactcctctcctcccgtcttct

SEQ ID NO: 28322 - DNA, 22 bp, Homo sapiens
tcactcctctcctcccgtcttc

SEQ ID NO: 28323 - DNA, 20 bp, Homo sapiens
tcactcctctcctcccgtct

SEQ ID NO: 28324 - DNA, 19 bp, Homo sapiens
tcactcctctcctcccgtc

SEQ ID NO: 28325 - DNA, 18 bp, Homo sapiens
tcactcctctcctcccgt

SEQ ID NO: 28326 - DNA, 27 bp, Homo sapiens
agacgggaggaaagaagggagtggttc

SEQ ID NO: 28327 - DNA, 28 bp, Homo sapiens
aagacgggaggaaagaagggagtggttc

SEQ ID NO: 28328 - DNA, 24 bp, Homo sapiens
agacgggaggaaagaagggagtgg

SEQ ID NO: 28329 - DNA, 23 bp, Homo sapiens
agacgggaggaaagaagggagtg

SEQ ID NO: 28330 - DNA, 24 bp, Homo sapiens
aagacgggaggaaagaagggagtg

SEQ ID NO: 28331 - DNA, 22 bp, Homo sapiens
agacgggaggaaagaagggagt

SEQ ID NO: 28332 - DNA, 23 bp, Homo sapiens
aagacgggaggaaagaagggagt

SEQ ID NO: 28333 - DNA, 21 bp, Homo sapiens
aagacgggaggaaagaaggga

SEQ ID NO: 28334 - DNA, 20 bp, Homo sapiens
tatctgctgggctttctggt

SEQ ID NO: 28335 - DNA, 21 bp, Homo sapiens
tatctgctgggctttctggtg

SEQ ID NO: 28336 - DNA, 22 bp, Homo sapiens
tatctgctgggctttctggtgt

SEQ ID NO: 28337 - DNA, 16 bp, Homo sapiens
cgagcgcagcggagcc

SEQ ID NO: 28338 - DNA, 18 bp, Homo sapiens
cgagcgcagcggagcctg

SEQ ID NO: 28339 - DNA, 19 bp, Homo sapiens
cgagcgcagcggagcctgg

SEQ ID NO: 28340 - DNA, 20 bp, Homo sapiens
cgagcgcagcggagcctgga

SEQ ID NO: 28341 - DNA, 22 bp, Homo sapiens
cgagcgcagcggagcctggaga

SEQ ID NO: 28342 - DNA, 23 bp, Homo sapiens
cgagcgcagcggagcctggagag

SEQ ID NO: 28343 - DNA, 24 bp, Homo sapiens
cgagcgcagcggagcctggagaga

SEQ ID NO: 28344 - DNA, 17 bp, Homo sapiens
gagcgcagcggagcctg

SEQ ID NO: 28345 - DNA, 23 bp, Homo sapiens
gagcgcagcggagcctggagaga

SEQ ID NO: 28346 - DNA, 25 bp, Homo sapiens
gagcgcagcggagcctggagagaag

SEQ ID NO: 28347 - DNA, 27 bp, Homo sapiens
gagcgcagcggagcctggagagaaggc

SEQ ID NO: 28348 - DNA, 16 bp, Homo sapiens
agcgcagcggagcctg

SEQ ID NO: 28349 - DNA, 24 bp, Homo sapiens
agcgcagcggagcctggagagaag

SEQ ID NO: 28350 - DNA, 19 bp, Homo sapiens
gcgcagcggagcctggaga

SEQ ID NO: 28351 - DNA, 23 bp, Homo sapiens
gcgcagcggagcctggagagaag

SEQ ID NO: 28352 - DNA, 28 bp, Homo sapiens
gcgcagcggagcctggagagaaggcgct

SEQ ID NO: 28353 - DNA, 18 bp, Homo sapiens
gcagcggagcctggagag

SEQ ID NO: 28354 - DNA, 20 bp, Homo sapiens
gcagcggagcctggagagaa

SEQ ID NO: 28355 - DNA, 28 bp, Homo sapiens
gcagcggagcctggagagaaggcgctgg

SEQ ID NO: 28356 - DNA, 16 bp, Homo sapiens
cagcggagcctggaga

SEQ ID NO: 28357 - DNA, 22 bp, Homo sapiens
cagcggagcctggagagaaggc

SEQ ID NO: 28358 - DNA, 23 bp, Homo sapiens
cagcggagcctggagagaaggcg

SEQ ID NO: 28359 - DNA, 18 bp, Homo sapiens
agcggagcctggagagaa

SEQ ID NO: 28360 - DNA, 20 bp, Homo sapiens
agcggagcctggagagaagg

SEQ ID NO: 28361 - DNA, 23 bp, Homo sapiens
agcggagcctggagagaaggcgc

SEQ ID NO: 28362 - DNA, 25 bp, Homo sapiens
agcggagcctggagagaaggcgctg

SEQ ID NO: 28363 - DNA, 19 bp, Homo sapiens
gcggagcctggagagaagg

SEQ ID NO: 28364 - DNA, 20 bp, Homo sapiens
gcggagcctggagagaaggc

SEQ ID NO: 28365 - DNA, 18 bp, Homo sapiens
cggagcctggagagaagg

SEQ ID NO: 28366 - DNA, 20 bp, Homo sapiens
cggagcctggagagaaggcg

SEQ ID NO: 28367 - DNA, 21 bp, Homo sapiens
cggagcctggagagaaggcgc

SEQ ID NO: 28368 - DNA, 22 bp, Homo sapiens
cggagcctggagagaaggcgct

SEQ ID NO: 28369 - DNA, 24 bp, Homo sapiens
cggagcctggagagaaggcgctgg

SEQ ID NO: 28370 - DNA, 19 bp, Homo sapiens
cctggagagaaggcgctgg

SEQ ID NO: 28371 - DNA, 24 bp, Homo sapiens
ggagggcagcgtgggtgtggcgga

SEQ ID NO: 28372 - DNA, 21 bp, Homo sapiens
gagggcagcgtgggtgtggcg

SEQ ID NO: 28373 - DNA, 22 bp, Homo sapiens
gagggcagcgtgggtgtggcgg

SEQ ID NO: 28374 - DNA, 24 bp, Homo sapiens
gagggcagcgtgggtgtggcggag

SEQ ID NO: 28375 - DNA, 22 bp, Homo sapiens
agggcagcgtgggtgtggcgga

SEQ ID NO: 28376 - DNA, 27 bp, Homo sapiens
gggcagcgtgggtgtggcggaggcagg

SEQ ID NO: 28377 - DNA, 22 bp, Homo sapiens
ggcagcgtgggtgtggcggagg

SEQ ID NO: 28378 - DNA, 16 bp, Homo sapiens
accgtttgccgccctc

SEQ ID NO: 28379 - DNA, 23 bp, Homo sapiens
ttgccgccctctcgctgctctag

SEQ ID NO: 28380 - DNA, 18 bp, Homo sapiens
tgccgccctctcgctgct

SEQ ID NO: 28381 - DNA, 20 bp, Homo sapiens
tgccgccctctcgctgctct

SEQ ID NO: 28382 - DNA, 21 bp, Homo sapiens
tgccgccctctcgctgctcta

SEQ ID NO: 28383 - DNA, 23 bp, Homo sapiens
tgccgccctctcgctgctctaga

SEQ ID NO: 28384 - DNA, 24 bp, Homo sapiens
tgccgccctctcgctgctctagac

SEQ ID NO: 28385 - DNA, 25 bp, Homo sapiens
tgccgccctctcgctgctctagacc

SEQ ID NO: 28386 - DNA, 22 bp, Homo sapiens
gccgccctctcgctgctctaga

SEQ ID NO: 28387 - DNA, 20 bp, Homo sapiens
cgccctctcgctgctctaga

SEQ ID NO: 28388 - DNA, 18 bp, Homo sapiens
gtctcccgctagctgatg

SEQ ID NO: 28389 - DNA, 22 bp, Homo sapiens
ctcgccctgtctcccgctagct

SEQ ID NO: 28390 - DNA, 23 bp, Homo sapiens
gctcgccctgtctcccgctagct

SEQ ID NO: 28391 - DNA, 24 bp, Homo sapiens
tgctcgccctgtctcccgctagct

SEQ ID NO: 28392 - DNA, 25 bp, Homo sapiens
ctgctcgccctgtctcccgctagct

SEQ ID NO: 28393 - DNA, 21 bp, Homo sapiens
ctcgccctgtctcccgctagc

SEQ ID NO: 28394 - DNA, 22 bp, Homo sapiens
gctcgccctgtctcccgctagc

SEQ ID NO: 28395 - DNA, 23 bp, Homo sapiens
tgctcgccctgtctcccgctagc

SEQ ID NO: 28396 - DNA, 24 bp, Homo sapiens
ctgctcgccctgtctcccgctagc

SEQ ID NO: 28397 - DNA, 21 bp, Homo sapiens
gctcgccctgtctcccgctag

SEQ ID NO: 28398 - DNA, 22 bp, Homo sapiens
tgctcgccctgtctcccgctag

SEQ ID NO: 28399 - DNA, 21 bp, Homo sapiens
tgctcgccctgtctcccgcta

SEQ ID NO: 28400 - DNA, 18 bp, Homo sapiens
ctcgccctgtctcccgct

SEQ ID NO: 28401 - DNA, 18 bp, Homo sapiens
gctcgccctgtctcccgc

SEQ ID NO: 28402 - DNA, 26 bp, Homo sapiens
ggcgggagctggggtctgcaggttcg

SEQ ID NO: 28403 - DNA, 23 bp, Homo sapiens
cgggagctggggtctgcaggttc

SEQ ID NO: 28404 - DNA, 24 bp, Homo sapiens
gcgggagctggggtctgcaggttc

SEQ ID NO: 28405 - DNA, 22 bp, Homo sapiens
cgggagctggggtctgcaggtt

SEQ ID NO: 28406 - DNA, 24 bp, Homo sapiens
ggcgggagctggggtctgcaggtt

SEQ ID NO: 28407 - DNA, 22 bp, Homo sapiens
gcgggagctggggtctgcaggt

SEQ ID NO: 28408 - DNA, 23 bp, Homo sapiens
ggcgggagctggggtctgcaggt

SEQ ID NO: 28409 - DNA, 26 bp, Homo sapiens
gggggcgggagctggggtctgcaggt

SEQ ID NO: 28410 - DNA, 21 bp, Homo sapiens
gcgggagctggggtctgcagg

SEQ ID NO: 28411 - DNA, 19 bp, Homo sapiens
cgggagctggggtctgcag

SEQ ID NO: 28412 - DNA, 20 bp, Homo sapiens
gcgggagctggggtctgcag

SEQ ID NO: 28413 - DNA, 21 bp, Homo sapiens
ggcgggagctggggtctgcag

SEQ ID NO: 28414 - DNA, 22 bp, Homo sapiens
gggcgggagctggggtctgcag

SEQ ID NO: 28415 - DNA, 22 bp, Homo sapiens
ggggcgggagctggggtctgca

SEQ ID NO: 28416 - DNA, 19 bp, Homo sapiens
agtacagatcggatgggtt

SEQ ID NO: 28417 - DNA, 24 bp, Homo sapiens
tcctgccacctcctccgcagggct

SEQ ID NO: 28418 - DNA, 23 bp, Homo sapiens
tcctgccacctcctccgcagggc

SEQ ID NO: 28419 - DNA, 24 bp, Homo sapiens
ctcctgccacctcctccgcagggc

SEQ ID NO: 28420 - DNA, 22 bp, Homo sapiens
tcctgccacctcctccgcaggg

SEQ ID NO: 28421 - DNA, 23 bp, Homo sapiens
ctcctgccacctcctccgcaggg

SEQ ID NO: 28422 - DNA, 21 bp, Homo sapiens
tcctgccacctcctccgcagg

SEQ ID NO: 28423 - DNA, 22 bp, Homo sapiens
ctcctgccacctcctccgcagg

SEQ ID NO: 28424 - DNA, 21 bp, Homo sapiens
ctcctgccacctcctccgcag

SEQ ID NO: 28425 - DNA, 23 bp, Homo sapiens
ggctcctgccacctcctccgcag

SEQ ID NO: 28426 - DNA, 19 bp, Homo sapiens
tcctgccacctcctccgca

SEQ ID NO: 28427 - DNA, 20 bp, Homo sapiens
ctcctgccacctcctccgca

SEQ ID NO: 28428 - DNA, 21 bp, Homo sapiens
gctcctgccacctcctccgca

SEQ ID NO: 28429 - DNA, 20 bp, Homo sapiens
ggctcctgccacctcctccg

SEQ ID NO: 28430 - DNA, 21 bp, Homo sapiens
aggcggctgggagcggccctc

SEQ ID NO: 28431 - DNA, 28 bp, Homo sapiens
ctcggggcaggcggctgggagcggccct

SEQ ID NO: 28432 - DNA, 24 bp, Homo sapiens
ctcggggcaggcggctgggagcgg

SEQ ID NO: 28433 - DNA, 25 bp, Homo sapiens
gctcggggcaggcggctgggagcgg

SEQ ID NO: 28434 - DNA, 22 bp, Homo sapiens
ctcggggcaggcggctgggagc

SEQ ID NO: 28435 - DNA, 21 bp, Homo sapiens
ctcggggcaggcggctgggag

SEQ ID NO: 28436 - DNA, 20 bp, Homo sapiens
ctcggggcaggcggctggga

SEQ ID NO: 28437 - DNA, 18 bp, Homo sapiens
gtgctcggggcaggcggc

SEQ ID NO: 28438 - DNA, 22 bp, Homo sapiens
tgacaccccatctgccctcaga

SEQ ID NO: 28439 - DNA, 23 bp, Homo sapiens
ctgacaccccatctgccctcaga

SEQ ID NO: 28440 - DNA, 21 bp, Homo sapiens
tgacaccccatctgccctcag

SEQ ID NO: 28441 - DNA, 22 bp, Homo sapiens
ctgacaccccatctgccctcag

SEQ ID NO: 28442 - DNA, 23 bp, Homo sapiens
cctgacaccccatctgccctcag

SEQ ID NO: 28443 - DNA, 20 bp, Homo sapiens
tgacaccccatctgccctca

SEQ ID NO: 28444 - DNA, 21 bp, Homo sapiens
ctgacaccccatctgccctca

SEQ ID NO: 28445 - DNA, 23 bp, Homo sapiens
ccctgacaccccatctgccctca

SEQ ID NO: 28446 - DNA, 21 bp, Homo sapiens
cctgacaccccatctgccctc

SEQ ID NO: 28447 - DNA, 22 bp, Homo sapiens
ccctgacaccccatctgccctc

SEQ ID NO: 28448 - DNA, 21 bp, Homo sapiens
ccctgacaccccatctgccct

SEQ ID NO: 28449 - DNA, 16 bp, Homo sapiens
ggttgtcagagctgcg

SEQ ID NO: 28450 - DNA, 18 bp, Homo sapiens
ggggttgtcagagctgcg

SEQ ID NO: 28451 - DNA, 19 bp, Homo sapiens
aggggttgtcagagctgcg

SEQ ID NO: 28452 - DNA, 20 bp, Homo sapiens
gaggggttgtcagagctgcg

SEQ ID NO: 28453 - DNA, 25 bp, Homo sapiens
aaaggtggaggggttgtcagagctg

SEQ ID NO: 28454 - DNA, 23 bp, Homo sapiens
aaggtggaggggttgtcagagct

SEQ ID NO: 28455 - DNA, 22 bp, Homo sapiens
aaggtggaggggttgtcagagc

SEQ ID NO: 28456 - DNA, 23 bp, Homo sapiens
aaaggtggaggggttgtcagagc

SEQ ID NO: 28457 - DNA, 22 bp, Homo sapiens
aaaggtggaggggttgtcagag

SEQ ID NO: 28458 - DNA, 24 bp, Homo sapiens
agaaaggtggaggggttgtcagag

SEQ ID NO: 28459 - DNA, 20 bp, Homo sapiens
aaggtggaggggttgtcaga

SEQ ID NO: 28460 - DNA, 21 bp, Homo sapiens
aaaggtggaggggttgtcaga

SEQ ID NO: 28461 - DNA, 22 bp, Homo sapiens
gaaaggtggaggggttgtcaga

SEQ ID NO: 28462 - DNA, 20 bp, Homo sapiens
aaaggtggaggggttgtcag

SEQ ID NO: 28463 - DNA, 22 bp, Homo sapiens
agaaaggtggaggggttgtcag

SEQ ID NO: 28464 - DNA, 19 bp, Homo sapiens
aaaggtggaggggttgtca

SEQ ID NO: 28465 - DNA, 18 bp, Homo sapiens
aaaggtggaggggttgtc

SEQ ID NO: 28466 - DNA, 25 bp, Homo sapiens
gtgtgaccaccgttcctgcaggccc

SEQ ID NO: 28467 - DNA, 24 bp, Homo sapiens
gtgtgaccaccgttcctgcaggcc

SEQ ID NO: 28468 - DNA, 23 bp, Homo sapiens
gtgtgaccaccgttcctgcaggc

SEQ ID NO: 28469 - DNA, 22 bp, Homo sapiens
gtgtgaccaccgttcctgcagg

SEQ ID NO: 28470 - DNA, 20 bp, Homo sapiens
gtgtgaccaccgttcctgca

SEQ ID NO: 28471 - DNA, 24 bp, Homo sapiens
ttgctgtgtgaccaccgttcctgc

SEQ ID NO: 28472 - DNA, 16 bp, Homo sapiens
tgggaccatgggggcc

SEQ ID NO: 28473 - DNA, 23 bp, Homo sapiens
caggcagggaggtgggaccatgg

SEQ ID NO: 28474 - DNA, 19 bp, Homo sapiens
caggcagggaggtgggacc

SEQ ID NO: 28475 - DNA, 21 bp, Homo sapiens
ggtgagctaaatgtgtgctgg

SEQ ID NO: 28476 - DNA, 24 bp, Homo sapiens
tgagctaaatgtgtgctgggacac

SEQ ID NO: 28477 - DNA, 22 bp, Homo sapiens
agctaaatgtgtgctgggacac

SEQ ID NO: 28478 - DNA, 18 bp, Homo sapiens
cggtgctggggagcggcc

SEQ ID NO: 28479 - DNA, 19 bp, Homo sapiens
tggggagcggcccccgggt

SEQ ID NO: 28480 - DNA, 21 bp, Homo sapiens
tggggagcggcccccgggtgg

SEQ ID NO: 28481 - DNA, 23 bp, Homo sapiens
tggggagcggcccccgggtgggc

SEQ ID NO: 28482 - DNA, 20 bp, Homo sapiens
cctcctggggcccgcactct

SEQ ID NO: 28483 - DNA, 23 bp, Homo sapiens
cctcctggggcccgcactctcgc

SEQ ID NO: 28484 - DNA, 25 bp, Homo sapiens
cctcctggggcccgcactctcgctc

SEQ ID NO: 28485 - DNA, 18 bp, Homo sapiens
ctcctggggcccgcactc

SEQ ID NO: 28486 - DNA, 19 bp, Homo sapiens
ctcctggggcccgcactct

SEQ ID NO: 28487 - DNA, 20 bp, Homo sapiens
ctcctggggcccgcactctc

SEQ ID NO: 28488 - DNA, 21 bp, Homo sapiens
ctcctggggcccgcactctcg

SEQ ID NO: 28489 - DNA, 23 bp, Homo sapiens
ctcctggggcccgcactctcgct

SEQ ID NO: 28490 - DNA, 24 bp, Homo sapiens
ctcctggggcccgcactctcgctc

SEQ ID NO: 28491 - DNA, 25 bp, Homo sapiens
ctcctggggcccgcactctcgctct

SEQ ID NO: 28492 - DNA, 27 bp, Homo sapiens
ctcctggggcccgcactctcgctctgg

SEQ ID NO: 28493 - DNA, 19 bp, Homo sapiens
ctggggcccgcactctcgc

SEQ ID NO: 28494 - DNA, 19 bp, Homo sapiens
cagccctcctcccgcaccc

SEQ ID NO: 28495 - DNA, 20 bp, Homo sapiens
cagccctcctcccgcaccca

SEQ ID NO: 28496 - DNA, 21 bp, Homo sapiens
cagccctcctcccgcacccaa

SEQ ID NO: 28497 - DNA, 23 bp, Homo sapiens
cagccctcctcccgcacccaaac

SEQ ID NO: 28498 - DNA, 24 bp, Homo sapiens
cagccctcctcccgcacccaaact

SEQ ID NO: 28499 - DNA, 23 bp, Homo sapiens
agccctcctcccgcacccaaact

SEQ ID NO: 28500 - DNA, 17 bp, Homo sapiens
tttggctgttggagggg

SEQ ID NO: 28501 - DNA, 19 bp, Homo sapiens
tttggctgttggagggggc

SEQ ID NO: 28502 - DNA, 21 bp, Homo sapiens
tttggctgttggagggggcag

SEQ ID NO: 28503 - DNA, 22 bp, Homo sapiens
tttggctgttggagggggcagg

SEQ ID NO: 28504 - DNA, 25 bp, Homo sapiens
tttggctgttggagggggcaggctc

SEQ ID NO: 28505 - DNA, 17 bp, Homo sapiens
ttggctgttggaggggg

SEQ ID NO: 28506 - DNA, 20 bp, Homo sapiens
ttggctgttggagggggcag

SEQ ID NO: 28507 - DNA, 21 bp, Homo sapiens
ttggctgttggagggggcagg

SEQ ID NO: 28508 - DNA, 22 bp, Homo sapiens
ttggctgttggagggggcaggc

SEQ ID NO: 28509 - DNA, 24 bp, Homo sapiens
ttggctgttggagggggcaggctc

SEQ ID NO: 28510 - DNA, 18 bp, Homo sapiens
tggctgttggagggggca

SEQ ID NO: 28511 - DNA, 19 bp, Homo sapiens
tggctgttggagggggcag

SEQ ID NO: 28512 - DNA, 20 bp, Homo sapiens
tggctgttggagggggcagg

SEQ ID NO: 28513 - DNA, 22 bp, Homo sapiens
tggctgttggagggggcaggct

SEQ ID NO: 28514 - DNA, 23 bp, Homo sapiens
tggctgttggagggggcaggctc

SEQ ID NO: 28515 - DNA, 21 bp, Homo sapiens
gtccctgagtgtatgtggtga

SEQ ID NO: 28516 - DNA, 22 bp, Homo sapiens
gtccctgagtgtatgtggtgaa

SEQ ID NO: 28517 - DNA, 23 bp, Homo sapiens
gtccctgagtgtatgtggtgaac

SEQ ID NO: 28518 - DNA, 24 bp, Homo sapiens
gtccctgagtgtatgtggtgaacc

SEQ ID NO: 28519 - DNA, 21 bp, Homo sapiens
ccctgagtgtatgtggtgaac

SEQ ID NO: 28520 - DNA, 22 bp, Homo sapiens
tttcctcatattcattcaggag

SEQ ID NO: 28521 - DNA, 23 bp, Homo sapiens
tttcctcatattcattcaggagt

SEQ ID NO: 28522 - DNA, 24 bp, Homo sapiens
tttcctcatattcattcaggagtg

SEQ ID NO: 28523 - DNA, 25 bp, Homo sapiens
tttcctcatattcattcaggagtgt

SEQ ID NO: 28524 - DNA, 20 bp, Homo sapiens
ttcctcatattcattcagga

SEQ ID NO: 28525 - DNA, 23 bp, Homo sapiens
ttcctcatattcattcaggagtg

SEQ ID NO: 28526 - DNA, 24 bp, Homo sapiens
ttcctcatattcattcaggagtgt

SEQ ID NO: 28527 - DNA, 21 bp, Homo sapiens
cctcatattcattcaggagtg

SEQ ID NO: 28528 - DNA, 22 bp, Homo sapiens
cctcatattcattcaggagtgt

SEQ ID NO: 28529 - DNA, 25 bp, Homo sapiens
ctttttgcggtctgggcttgctgta

SEQ ID NO: 28530 - DNA, 26 bp, Homo sapiens
ctttttgcggtctgggcttgctgtac

SEQ ID NO: 28531 - DNA, 27 bp, Homo sapiens
ctttttgcggtctgggcttgctgtaca

SEQ ID NO: 28532 - DNA, 21 bp, Homo sapiens
gaagcccttaccccaaaaagc

SEQ ID NO: 28533 - DNA, 20 bp, Homo sapiens
aagcccttaccccaaaaagc

SEQ ID NO: 28534 - DNA, 21 bp, Homo sapiens
aagcccttaccccaaaaagca

SEQ ID NO: 28535 - DNA, 23 bp, Homo sapiens
aagcccttaccccaaaaagcatt

SEQ ID NO: 28536 - DNA, 24 bp, Homo sapiens
aagcccttaccccaaaaagcattt

SEQ ID NO: 28537 - DNA, 27 bp, Homo sapiens
aagcccttaccccaaaaagcatttgcg

SEQ ID NO: 28538 - DNA, 21 bp, Homo sapiens
cctgagctgggtgagggcatc

SEQ ID NO: 28539 - DNA, 21 bp, Homo sapiens
gctgggtgagggcatctgtgg

SEQ ID NO: 28540 - DNA, 22 bp, Homo sapiens
gctgggtgagggcatctgtggt

SEQ ID NO: 28541 - DNA, 17 bp, Homo sapiens
ctgggtgagggcatctg

SEQ ID NO: 28542 - DNA, 18 bp, Homo sapiens
ctgggtgagggcatctgt

SEQ ID NO: 28543 - DNA, 20 bp, Homo sapiens
ctgggtgagggcatctgtgg

SEQ ID NO: 28544 - DNA, 22 bp, Homo sapiens
ctgggtgagggcatctgtggtt

SEQ ID NO: 28545 - DNA, 23 bp, Homo sapiens
ctgggtgagggcatctgtggttt

SEQ ID NO: 28546 - DNA, 20 bp, Homo sapiens
tgggtgagggcatctgtggt

SEQ ID NO: 28547 - DNA, 21 bp, Homo sapiens
ctcagctcctctctacccaca

SEQ ID NO: 28548 - DNA, 23 bp, Homo sapiens
ctcagctcctctctacccacaga

SEQ ID NO: 28549 - DNA, 19 bp, Homo sapiens
tcagctcctctctacccac

SEQ ID NO: 28550 - DNA, 20 bp, Homo sapiens
tcagctcctctctacccaca

SEQ ID NO: 28551 - DNA, 22 bp, Homo sapiens
tcagctcctctctacccacaga

SEQ ID NO: 28552 - DNA, 23 bp, Homo sapiens
tcagctcctctctacccacagag

SEQ ID NO: 28553 - DNA, 24 bp, Homo sapiens
tcagctcctctctacccacagagt

SEQ ID NO: 28554 - DNA, 25 bp, Homo sapiens
tcagctcctctctacccacagagtc

SEQ ID NO: 28555 - DNA, 24 bp, Homo sapiens
gtaggggcagcagaggacctgggc

SEQ ID NO: 28556 - DNA, 20 bp, Homo sapiens
taggggcagcagaggacctg

SEQ ID NO: 28557 - DNA, 21 bp, Homo sapiens
taggggcagcagaggacctgg

SEQ ID NO: 28558 - DNA, 23 bp, Homo sapiens
taggggcagcagaggacctgggc

SEQ ID NO: 28559 - DNA, 24 bp, Homo sapiens
taggggcagcagaggacctgggcc

SEQ ID NO: 28560 - DNA, 25 bp, Homo sapiens
taggggcagcagaggacctgggcct

SEQ ID NO: 28561 - DNA, 26 bp, Homo sapiens
taggggcagcagaggacctgggcctg

SEQ ID NO: 28562 - DNA, 28 bp, Homo sapiens
taggggcagcagaggacctgggcctgga

SEQ ID NO: 28563 - DNA, 22 bp, Homo sapiens
ggcagcagaggacctgggcctg

SEQ ID NO: 28564 - DNA, 21 bp, Homo sapiens
agactagaaagcccagggcag

SEQ ID NO: 28565 - DNA, 23 bp, Homo sapiens
tgagactagaaagcccagggcag

SEQ ID NO: 28566 - DNA, 24 bp, Homo sapiens
gctttctagtctcagctctcctga

SEQ ID NO: 28567 - DNA, 25 bp, Homo sapiens
gctttctagtctcagctctcctgac

SEQ ID NO: 28568 - DNA, 20 bp, Homo sapiens
caggagagctgagactagaa

SEQ ID NO: 28569 - DNA, 18 bp, Homo sapiens
gtcaggagagctgagact

SEQ ID NO: 28570 - DNA, 17 bp, Homo sapiens
gtcaggagagctgagac

SEQ ID NO: 28571 - DNA, 18 bp, Homo sapiens
tctcagctctcctccagc

SEQ ID NO: 28572 - DNA, 24 bp, Homo sapiens
gctttctagtctcagctctcctcc

SEQ ID NO: 28573 - DNA, 24 bp, Homo sapiens
gaggagagctgagactagaaagcc

SEQ ID NO: 28574 - DNA, 25 bp, Homo sapiens
taaaactttaagtgtgcctaggaag

SEQ ID NO: 28575 - DNA, 24 bp, Homo sapiens
taaaactttaagtgtgcctaggaa

SEQ ID NO: 28576 - DNA, 22 bp, Homo sapiens
aaaactttaagtgtgcctagga

SEQ ID NO: 28577 - DNA, 23 bp, Homo sapiens
taaaactttaagtgtgcctagga

SEQ ID NO: 28578 - DNA, 21 bp, Homo sapiens
aaaactttaagtgtgcctagg

SEQ ID NO: 28579 - DNA, 23 bp, Homo sapiens
ttaaaactttaagtgtgcctagg

SEQ ID NO: 28580 - DNA, 24 bp, Homo sapiens
gttaaaactttaagtgtgcctagg

SEQ ID NO: 28581 - DNA, 21 bp, Homo sapiens
taaaactttaagtgtgcctag

SEQ ID NO: 28582 - DNA, 22 bp, Homo sapiens
ttaaaactttaagtgtgcctag

SEQ ID NO: 28583 - DNA, 21 bp, Homo sapiens
ttaaaactttaagtgtgccta

SEQ ID NO: 28584 - DNA, 22 bp, Homo sapiens
gttaaaactttaagtgtgccta

SEQ ID NO: 28585 - DNA, 21 bp, Homo sapiens
gttaaaactttaagtgtgcct

SEQ ID NO: 28586 - DNA, 21 bp, Homo sapiens
ggcacacttaaagttatagct

SEQ ID NO: 28587 - DNA, 22 bp, Homo sapiens
aggcacacttaaagttatagct

SEQ ID NO: 28588 - DNA, 23 bp, Homo sapiens
taggcacacttaaagttatagct

SEQ ID NO: 28589 - DNA, 20 bp, Homo sapiens
ggcacacttaaagttatagc

SEQ ID NO: 28590 - DNA, 21 bp, Homo sapiens
aggcacacttaaagttatagc

SEQ ID NO: 28591 - DNA, 21 bp, Homo sapiens
taggcacacttaaagttatag

SEQ ID NO: 28592 - DNA, 20 bp, Homo sapiens
taggcacacttaaagttata

SEQ ID NO: 28593 - DNA, 24 bp, Homo sapiens
cctgggtggaagaaggtctggttc

SEQ ID NO: 28594 - DNA, 24 bp, Homo sapiens
tcctgggtggaagaaggtctggtt

SEQ ID NO: 28595 - DNA, 20 bp, Homo sapiens
ctgggtggaagaaggtctgg

SEQ ID NO: 28596 - DNA, 21 bp, Homo sapiens
cctgggtggaagaaggtctgg

SEQ ID NO: 28597 - DNA, 22 bp, Homo sapiens
tcctgggtggaagaaggtctgg

SEQ ID NO: 28598 - DNA, 16 bp, Homo sapiens
tgctggcatgttaagt

SEQ ID NO: 28599 - DNA, 20 bp, Homo sapiens
gctttgctggcatgttaagt

SEQ ID NO: 28600 - DNA, 20 bp, Homo sapiens
agctttgctggcatgttaag

SEQ ID NO: 28601 - DNA, 22 bp, Homo sapiens
gtagctttgctggcatgttaag

SEQ ID NO: 28602 - DNA, 20 bp, Homo sapiens
tagctttgctggcatgttaa

SEQ ID NO: 28603 - DNA, 26 bp, Homo sapiens
cgggtttgtagctttgctggcatgtt

SEQ ID NO: 28604 - DNA, 27 bp, Homo sapiens
acgggtttgtagctttgctggcatgtt

SEQ ID NO: 28605 - DNA, 18 bp, Homo sapiens
gtagctttgctggcatgt

SEQ ID NO: 28606 - DNA, 26 bp, Homo sapiens
tacgggtttgtagctttgctggcatg

SEQ ID NO: 28607 - DNA, 28 bp, Homo sapiens
tctacgggtttgtagctttgctggcatg

SEQ ID NO: 28608 - DNA, 24 bp, Homo sapiens
tacgggtttgtagctttgctggca

SEQ ID NO: 28609 - DNA, 18 bp, Homo sapiens
ttctacgggtttgtagct

SEQ ID NO: 28610 - DNA, 17 bp, Homo sapiens
ttctacgggtttgtagc

SEQ ID NO: 28611 - DNA, 21 bp, Homo sapiens
gctgataagaacagaggccca

SEQ ID NO: 28612 - DNA, 22 bp, Homo sapiens
gctgataagaacagaggcccag

SEQ ID NO: 28613 - DNA, 23 bp, Homo sapiens
gctgataagaacagaggcccaga

SEQ ID NO: 28614 - DNA, 21 bp, Homo sapiens
ctgataagaacagaggcccag

SEQ ID NO: 28615 - DNA, 22 bp, Homo sapiens
ctgataagaacagaggcccaga

SEQ ID NO: 28616 - DNA, 24 bp, Homo sapiens
ctgataagaacagaggcccagatt

SEQ ID NO: 28617 - DNA, 18 bp, Homo sapiens
gagagggagaaagctaga

SEQ ID NO: 28618 - DNA, 26 bp, Homo sapiens
gagggagaaagctagaagctgaagat

SEQ ID NO: 28619 - DNA, 21 bp, Homo sapiens
agggagaaagctagaagctga

SEQ ID NO: 28620 - DNA, 22 bp, Homo sapiens
agggagaaagctagaagctgaa

SEQ ID NO: 28621 - DNA, 24 bp, Homo sapiens
agggagaaagctagaagctgaaga

SEQ ID NO: 28622 - DNA, 25 bp, Homo sapiens
agggagaaagctagaagctgaagat

SEQ ID NO: 28623 - DNA, 26 bp, Homo sapiens
agggagaaagctagaagctgaagatt

SEQ ID NO: 28624 - DNA, 16 bp, Homo sapiens
cactaactggcctctt

SEQ ID NO: 28625 - DNA, 27 bp, Homo sapiens
cactaactggcctcttctttctcctag

SEQ ID NO: 28626 - DNA, 28 bp, Homo sapiens
actaactggcctcttctttctcctaggt

SEQ ID NO: 28627 - DNA, 19 bp, Homo sapiens
ctggcctcttctttctcct

SEQ ID NO: 28628 - DNA, 20 bp, Homo sapiens
ctggcctcttctttctccta

SEQ ID NO: 28629 - DNA, 22 bp, Homo sapiens
ctggcctcttctttctcctagg

SEQ ID NO: 28630 - DNA, 23 bp, Homo sapiens
ctggcctcttctttctcctaggt

SEQ ID NO: 28631 - DNA, 24 bp, Homo sapiens
agggcccagaggtggggactgagc

SEQ ID NO: 28632 - DNA, 19 bp, Homo sapiens
ccagaggtggggactgagc

SEQ ID NO: 28633 - DNA, 26 bp, Homo sapiens
tctgtgcttcacccctacccagcttc

SEQ ID NO: 28634 - DNA, 25 bp, Homo sapiens
tctgtgcttcacccctacccagctt

SEQ ID NO: 28635 - DNA, 21 bp, Homo sapiens
gtgcttcacccctacccagct

SEQ ID NO: 28636 - DNA, 24 bp, Homo sapiens
tctgtgcttcacccctacccagct

SEQ ID NO: 28637 - DNA, 22 bp, Homo sapiens
ctgtgcttcacccctacccagc

SEQ ID NO: 28638 - DNA, 23 bp, Homo sapiens
tctgtgcttcacccctacccagc

SEQ ID NO: 28639 - DNA, 23 bp, Homo sapiens
ctctgtgcttcacccctacccag

SEQ ID NO: 28640 - DNA, 21 bp, Homo sapiens
tctgtgcttcacccctaccca

SEQ ID NO: 28641 - DNA, 20 bp, Homo sapiens
tctgtgcttcacccctaccc

SEQ ID NO: 28642 - DNA, 19 bp, Homo sapiens
tctgtgcttcacccctacc

SEQ ID NO: 28643 - DNA, 17 bp, Homo sapiens
tctgtgcttcaccccta

SEQ ID NO: 28644 - DNA, 26 bp, Homo sapiens
ttggggtggtcggccctggagggggt

SEQ ID NO: 28645 - DNA, 24 bp, Homo sapiens
ttggggtggtcggccctggagggg

SEQ ID NO: 28646 - DNA, 21 bp, Homo sapiens
tggggtggtcggccctggagg

SEQ ID NO: 28647 - DNA, 22 bp, Homo sapiens
ttggggtggtcggccctggagg

SEQ ID NO: 28648 - DNA, 23 bp, Homo sapiens
gttggggtggtcggccctggagg

SEQ ID NO: 28649 - DNA, 26 bp, Homo sapiens
tgggttggggtggtcggccctggagg

SEQ ID NO: 28650 - DNA, 27 bp, Homo sapiens
ttgggttggggtggtcggccctggagg

SEQ ID NO: 28651 - DNA, 20 bp, Homo sapiens
tggggtggtcggccctggag

SEQ ID NO: 28652 - DNA, 26 bp, Homo sapiens
ttgggttggggtggtcggccctggag

SEQ ID NO: 28653 - DNA, 25 bp, Homo sapiens
ttgggttggggtggtcggccctgga

SEQ ID NO: 28654 - DNA, 20 bp, Homo sapiens
tttgggttggggtggtcggc

SEQ ID NO: 28655 - DNA, 25 bp, Homo sapiens
gggggagtgcagtgattgtggaatg

SEQ ID NO: 28656 - DNA, 26 bp, Homo sapiens
tgggggagtgcagtgattgtggaatg

SEQ ID NO: 28657 - DNA, 24 bp, Homo sapiens
tgggggagtgcagtgattgtggaa

SEQ ID NO: 28658 - DNA, 23 bp, Homo sapiens
tgggggagtgcagtgattgtgga

SEQ ID NO: 28659 - DNA, 21 bp, Homo sapiens
tgggggagtgcagtgattgtg

SEQ ID NO: 28660 - DNA, 20 bp, Homo sapiens
tgggggagtgcagtgattgt

SEQ ID NO: 28661 - DNA, 18 bp, Homo sapiens
tgggggagtgcagtgatt

SEQ ID NO: 28662 - DNA, 25 bp, Homo sapiens
tgatatgtttgatattgggttgttt

SEQ ID NO: 28663 - DNA, 24 bp, Homo sapiens
tgatatgtttgatattgggttgtt

SEQ ID NO: 28664 - DNA, 22 bp, Homo sapiens
gatatgtttgatattgggttgt

SEQ ID NO: 28665 - DNA, 23 bp, Homo sapiens
tgatatgtttgatattgggttgt

SEQ ID NO: 28666 - DNA, 18 bp, Homo sapiens
atgtttgatattgggttg

SEQ ID NO: 28667 - DNA, 22 bp, Homo sapiens
tgatatgtttgatattgggttg

SEQ ID NO: 28668 - DNA, 20 bp, Homo sapiens
tgatatgtttgatattgggt

SEQ ID NO: 28669 - DNA, 19 bp, Homo sapiens
tgatatgtttgatattggg

SEQ ID NO: 28670 - DNA, 24 bp, Homo sapiens
cccccgccccgccaccgccttgga

SEQ ID NO: 28671 - DNA, 27 bp, Homo sapiens
cccgccccgccaccgccttggaggctg

SEQ ID NO: 28672 - DNA, 22 bp, Homo sapiens
cccgccaccgccttggaggctg

SEQ ID NO: 28673 - DNA, 16 bp, Homo sapiens
accgccttggaggctg

SEQ ID NO: 28674 - DNA, 16 bp, Homo sapiens
agggacgggacgcggt

SEQ ID NO: 28675 - DNA, 17 bp, Homo sapiens
agggacgggacgcggtg

SEQ ID NO: 28676 - DNA, 18 bp, Homo sapiens
agggacgggacgcggtgc

SEQ ID NO: 28677 - DNA, 19 bp, Homo sapiens
agggacgggacgcggtgca

SEQ ID NO: 28678 - DNA, 20 bp, Homo sapiens
agggacgggacgcggtgcag

SEQ ID NO: 28679 - DNA, 21 bp, Homo sapiens
agggacgggacgcggtgcagt

SEQ ID NO: 28680 - DNA, 23 bp, Homo sapiens
agggacgggacgcggtgcagtgt

SEQ ID NO: 28681 - DNA, 24 bp, Homo sapiens
agggacgggacgcggtgcagtgtt

SEQ ID NO: 28682 - DNA, 25 bp, Homo sapiens
agggacgggacgcggtgcagtgttg

SEQ ID NO: 28683 - DNA, 26 bp, Homo sapiens
agggacgggacgcggtgcagtgttgt

SEQ ID NO: 28684 - DNA, 18 bp, Homo sapiens
atattgcactcgtcccgg

SEQ ID NO: 28685 - DNA, 18 bp, Homo sapiens
tattgcactcgtcccggc

SEQ ID NO: 28686 - DNA, 19 bp, Homo sapiens
tattgcactcgtcccggcc

SEQ ID NO: 28687 - DNA, 20 bp, Homo sapiens
tattgcactcgtcccggcct

SEQ ID NO: 28688 - DNA, 21 bp, Homo sapiens
tattgcactcgtcccggcctc

SEQ ID NO: 28689 - DNA, 23 bp, Homo sapiens
tattgcactcgtcccggcctccg

SEQ ID NO: 28690 - DNA, 24 bp, Homo sapiens
tattgcactcgtcccggcctccgg

SEQ ID NO: 28691 - DNA, 25 bp, Homo sapiens
tattgcactcgtcccggcctccggc

SEQ ID NO: 28692 - DNA, 22 bp, Homo sapiens
attgcactcgtcccggcctccg

SEQ ID NO: 28693 - DNA, 18 bp, Homo sapiens
tgaacctctgataaaact

SEQ ID NO: 28694 - DNA, 19 bp, Homo sapiens
ggtaagctgaacctctgat

SEQ ID NO: 28695 - DNA, 22 bp, Homo sapiens
acagggtaagctgaacctctga

SEQ ID NO: 28696 - DNA, 24 bp, Homo sapiens
gtggacagggtaagctgaacctct

SEQ ID NO: 28697 - DNA, 16 bp, Homo sapiens
gtggacagggtaagct

SEQ ID NO: 28698 - DNA, 21 bp, Homo sapiens
tgcctgcattctactcccagg

SEQ ID NO: 28699 - DNA, 23 bp, Homo sapiens
tctgcctgcattctactcccagg

SEQ ID NO: 28700 - DNA, 24 bp, Homo sapiens
ttctgcctgcattctactcccagg

SEQ ID NO: 28701 - DNA, 25 bp, Homo sapiens
cttctgcctgcattctactcccagg

SEQ ID NO: 28702 - DNA, 26 bp, Homo sapiens
ccttctgcctgcattctactcccagg

SEQ ID NO: 28703 - DNA, 22 bp, Homo sapiens
tctgcctgcattctactcccag

SEQ ID NO: 28704 - DNA, 23 bp, Homo sapiens
ttctgcctgcattctactcccag

SEQ ID NO: 28705 - DNA, 25 bp, Homo sapiens
ccttctgcctgcattctactcccag

SEQ ID NO: 28706 - DNA, 23 bp, Homo sapiens
cttctgcctgcattctactccca

SEQ ID NO: 28707 - DNA, 24 bp, Homo sapiens
ccttctgcctgcattctactccca

SEQ ID NO: 28708 - DNA, 22 bp, Homo sapiens
cttctgcctgcattctactccc

SEQ ID NO: 28709 - DNA, 23 bp, Homo sapiens
ccttctgcctgcattctactccc

SEQ ID NO: 28710 - DNA, 20 bp, Homo sapiens
cttctgcctgcattctactc

SEQ ID NO: 28711 - DNA, 19 bp, Homo sapiens
cttctgcctgcattctact

SEQ ID NO: 28712 - DNA, 20 bp, Homo sapiens
ccttctgcctgcattctact

SEQ ID NO: 28713 - DNA, 24 bp, Homo sapiens
aggggtagaagagcacaggggttc

SEQ ID NO: 28714 - DNA, 23 bp, Homo sapiens
aggggtagaagagcacaggggtt

SEQ ID NO: 28715 - DNA, 24 bp, Homo sapiens
cgaggggtagaagagcacaggggt

SEQ ID NO: 28716 - DNA, 21 bp, Homo sapiens
aggggtagaagagcacagggg

SEQ ID NO: 28717 - DNA, 22 bp, Homo sapiens
cgaggggtagaagagcacaggg

SEQ ID NO: 28718 - DNA, 21 bp, Homo sapiens
tagataaccgaaagtaaaaat

SEQ ID NO: 28719 - DNA, 27 bp, Homo sapiens
taaagctagataaccgaaagtaaaaat

SEQ ID NO: 28720 - DNA, 28 bp, Homo sapiens
ataaagctagataaccgaaagtaaaaat

SEQ ID NO: 28721 - DNA, 16 bp, Homo sapiens
agctgtatgagtggtg

SEQ ID NO: 28722 - DNA, 28 bp, Homo sapiens
ctttggttatctagctgtatgagtggtg

SEQ ID NO: 28723 - DNA, 26 bp, Homo sapiens
tttggttatctagctgtatgagtggt

SEQ ID NO: 28724 - DNA, 27 bp, Homo sapiens
ctttggttatctagctgtatgagtggt

SEQ ID NO: 28725 - DNA, 28 bp, Homo sapiens
tctttggttatctagctgtatgagtggt

SEQ ID NO: 28726 - DNA, 27 bp, Homo sapiens
tctttggttatctagctgtatgagtgg

SEQ ID NO: 28727 - DNA, 18 bp, Homo sapiens
actggaattggagtcaaa

SEQ ID NO: 28728 - DNA, 20 bp, Homo sapiens
actggaattggagtcaaaaa

SEQ ID NO: 28729 - DNA, 22 bp, Homo sapiens
actggaattggagtcaaaaata

SEQ ID NO: 28730 - DNA, 27 bp, Homo sapiens
ctgtgcgtgtgacagcggctgatctgt

SEQ ID NO: 28731 - DNA, 24 bp, Homo sapiens
ctgtgcgtgtgacagcggctgatc

SEQ ID NO: 28732 - DNA, 23 bp, Homo sapiens
ctgtgcgtgtgacagcggctgat

SEQ ID NO: 28733 - DNA, 23 bp, Homo sapiens
actgtgcgtgtgacagcggctga

SEQ ID NO: 28734 - DNA, 21 bp, Homo sapiens
ctgtgcgtgtgacagcggctg

SEQ ID NO: 28735 - DNA, 20 bp, Homo sapiens
ctgtgcgtgtgacagcggct

SEQ ID NO: 28736 - DNA, 19 bp, Homo sapiens
ctgtgcgtgtgacagcggc

SEQ ID NO: 28737 - DNA, 18 bp, Homo sapiens
ctgtgcgtgtgacagcgg

SEQ ID NO: 28738 - DNA, 17 bp, Homo sapiens
ctgtgcgtgtgacagcg

SEQ ID NO: 28739 - DNA, 25 bp, Homo sapiens
agcccctgcccaccgcacactgcgc

SEQ ID NO: 28740 - DNA, 24 bp, Homo sapiens
agcccctgcccaccgcacactgcg

SEQ ID NO: 28741 - DNA, 23 bp, Homo sapiens
agcccctgcccaccgcacactgc

SEQ ID NO: 28742 - DNA, 21 bp, Homo sapiens
agcccctgcccaccgcacact

SEQ ID NO: 28743 - DNA, 20 bp, Homo sapiens
agcccctgcccaccgcacac

SEQ ID NO: 28744 - DNA, 19 bp, Homo sapiens
agcccctgcccaccgcaca

SEQ ID NO: 28745 - DNA, 24 bp, Homo sapiens
aggagaaggaaggtgatgaaggat

SEQ ID NO: 28746 - DNA, 27 bp, Homo sapiens
tggaggagaaggaaggtgatgaaggat

SEQ ID NO: 28747 - DNA, 25 bp, Homo sapiens
tggaggagaaggaaggtgatgaagg

SEQ ID NO: 28748 - DNA, 24 bp, Homo sapiens
tggaggagaaggaaggtgatgaag

SEQ ID NO: 28749 - DNA, 23 bp, Homo sapiens
tggaggagaaggaaggtgatgaa

SEQ ID NO: 28750 - DNA, 24 bp, Homo sapiens
ctggaggagaaggaaggtgatgaa

SEQ ID NO: 28751 - DNA, 25 bp, Homo sapiens
tctggaggagaaggaaggtgatgaa

SEQ ID NO: 28752 - DNA, 22 bp, Homo sapiens
tggaggagaaggaaggtgatga

SEQ ID NO: 28753 - DNA, 23 bp, Homo sapiens
ctggaggagaaggaaggtgatga

SEQ ID NO: 28754 - DNA, 20 bp, Homo sapiens
ggaggagaaggaaggtgatg

SEQ ID NO: 28755 - DNA, 22 bp, Homo sapiens
ctggaggagaaggaaggtgatg

SEQ ID NO: 28756 - DNA, 23 bp, Homo sapiens
tctggaggagaaggaaggtgatg

SEQ ID NO: 28757 - DNA, 20 bp, Homo sapiens
tggaggagaaggaaggtgat

SEQ ID NO: 28758 - DNA, 21 bp, Homo sapiens
ctggaggagaaggaaggtgat

SEQ ID NO: 28759 - DNA, 22 bp, Homo sapiens
tctggaggagaaggaaggtgat

SEQ ID NO: 28760 - DNA, 20 bp, Homo sapiens
ctggaggagaaggaaggtga

SEQ ID NO: 28761 - DNA, 21 bp, Homo sapiens
tctggaggagaaggaaggtga

SEQ ID NO: 28762 - DNA, 19 bp, Homo sapiens
tctggaggagaaggaaggt

SEQ ID NO: 28763 - DNA, 18 bp, Homo sapiens
gctcttttcacattgtgc

SEQ ID NO: 28764 - DNA, 19 bp, Homo sapiens
gctcttttcacattgtgct

SEQ ID NO: 28765 - DNA, 20 bp, Homo sapiens
gctcttttcacattgtgcta

SEQ ID NO: 28766 - DNA, 21 bp, Homo sapiens
gctcttttcacattgtgctac

SEQ ID NO: 28767 - DNA, 22 bp, Homo sapiens
gctcttttcacattgtgctact

SEQ ID NO: 28768 - DNA, 23 bp, Homo sapiens
gctcttttcacattgtgctactg

SEQ ID NO: 28769 - DNA, 24 bp, Homo sapiens
gctcttttcacattgtgctactgt

SEQ ID NO: 28770 - DNA, 25 bp, Homo sapiens
gctcttttcacattgtgctactgtc

SEQ ID NO: 28771 - DNA, 24 bp, Homo sapiens
ctcttttcacattgtgctactgtc

SEQ ID NO: 28772 - DNA, 23 bp, Homo sapiens
tcttttcacattgtgctactgtc

SEQ ID NO: 28773 - DNA, 20 bp, Homo sapiens
cagtgcaatgttaaaagggc

SEQ ID NO: 28774 - DNA, 21 bp, Homo sapiens
cagtgcaatgttaaaagggca

SEQ ID NO: 28775 - DNA, 23 bp, Homo sapiens
cagtgcaatgttaaaagggcatt

SEQ ID NO: 28776 - DNA, 24 bp, Homo sapiens
cagtgcaatgttaaaagggcattg

SEQ ID NO: 28777 - DNA, 26 bp, Homo sapiens
cagtgcaatgttaaaagggcattggc

SEQ ID NO: 28778 - DNA, 25 bp, Homo sapiens
tccctacccctccactccccaaaaa

SEQ ID NO: 28779 - DNA, 24 bp, Homo sapiens
tccctacccctccactccccaaaa

SEQ ID NO: 28780 - DNA, 23 bp, Homo sapiens
tccctacccctccactccccaaa

SEQ ID NO: 28781 - DNA, 22 bp, Homo sapiens
tccctacccctccactccccaa

SEQ ID NO: 28782 - DNA, 22 bp, Homo sapiens
ctccctacccctccactcccca

SEQ ID NO: 28783 - DNA, 20 bp, Homo sapiens
tccctacccctccactcccc

SEQ ID NO: 28784 - DNA, 19 bp, Homo sapiens
tccctacccctccactccc

SEQ ID NO: 28785 - DNA, 25 bp, Homo sapiens
agggagtagaagggtggggagcatg

SEQ ID NO: 28786 - DNA, 24 bp, Homo sapiens
agggagtagaagggtggggagcat

SEQ ID NO: 28787 - DNA, 23 bp, Homo sapiens
agggagtagaagggtggggagca

SEQ ID NO: 28788 - DNA, 22 bp, Homo sapiens
agggagtagaagggtggggagc

SEQ ID NO: 28789 - DNA, 24 bp, Homo sapiens
ttagggagtagaagggtggggagc

SEQ ID NO: 28790 - DNA, 21 bp, Homo sapiens
agggagtagaagggtggggag

SEQ ID NO: 28791 - DNA, 20 bp, Homo sapiens
agggagtagaagggtgggga

SEQ ID NO: 28792 - DNA, 22 bp, Homo sapiens
ttagggagtagaagggtgggga

SEQ ID NO: 28793 - DNA, 21 bp, Homo sapiens
ttagggagtagaagggtgggg

SEQ ID NO: 28794 - DNA, 19 bp, Homo sapiens
ttagggagtagaagggtgg

SEQ ID NO: 28795 - DNA, 18 bp, Homo sapiens
ttagggagtagaagggtg

SEQ ID NO: 28796 - DNA, 25 bp, Homo sapiens
ggactaggatgcagacctccctggg

SEQ ID NO: 28797 - DNA, 23 bp, Homo sapiens
gactaggatgcagacctccctgg

SEQ ID NO: 28798 - DNA, 24 bp, Homo sapiens
ggactaggatgcagacctccctgg

SEQ ID NO: 28799 - DNA, 22 bp, Homo sapiens
gactaggatgcagacctccctg

SEQ ID NO: 28800 - DNA, 23 bp, Homo sapiens
ggactaggatgcagacctccctg

SEQ ID NO: 28801 - DNA, 21 bp, Homo sapiens
gactaggatgcagacctccct

SEQ ID NO: 28802 - DNA, 22 bp, Homo sapiens
ggactaggatgcagacctccct

SEQ ID NO: 28803 - DNA, 20 bp, Homo sapiens
gactaggatgcagacctccc

SEQ ID NO: 28804 - DNA, 21 bp, Homo sapiens
ggactaggatgcagacctccc

SEQ ID NO: 28805 - DNA, 22 bp, Homo sapiens
gggactaggatgcagacctccc

SEQ ID NO: 28806 - DNA, 20 bp, Homo sapiens
ggactaggatgcagacctcc

SEQ ID NO: 28807 - DNA, 23 bp, Homo sapiens
aggggactaggatgcagacctcc

SEQ ID NO: 28808 - DNA, 19 bp, Homo sapiens
ggactaggatgcagacctc

SEQ ID NO: 28809 - DNA, 20 bp, Homo sapiens
aggggactaggatgcagacc

SEQ ID NO: 28810 - DNA, 21 bp, Homo sapiens
tgcattcaaatccccagaagc

SEQ ID NO: 28811 - DNA, 22 bp, Homo sapiens
ctgcattcaaatccccagaagc

SEQ ID NO: 28812 - DNA, 24 bp, Homo sapiens
gtctgcattcaaatccccagaagc

SEQ ID NO: 28813 - DNA, 26 bp, Homo sapiens
aggtctgcattcaaatccccagaagc

SEQ ID NO: 28814 - DNA, 25 bp, Homo sapiens
aggtctgcattcaaatccccagaag

SEQ ID NO: 28815 - DNA, 24 bp, Homo sapiens
aggtctgcattcaaatccccagaa

SEQ ID NO: 28816 - DNA, 22 bp, Homo sapiens
aggtctgcattcaaatccccag

SEQ ID NO: 28817 - DNA, 21 bp, Homo sapiens
aggtctgcattcaaatcccca

SEQ ID NO: 28818 - DNA, 23 bp, Homo sapiens
ggaggtctgcattcaaatcccca

SEQ ID NO: 28819 - DNA, 20 bp, Homo sapiens
aggtctgcattcaaatcccc

SEQ ID NO: 28820 - DNA, 21 bp, Homo sapiens
gaggtctgcattcaaatcccc

SEQ ID NO: 28821 - DNA, 22 bp, Homo sapiens
ggaggtctgcattcaaatcccc

SEQ ID NO: 28822 - DNA, 21 bp, Homo sapiens
ggaggtctgcattcaaatccc

SEQ ID NO: 28823 - DNA, 23 bp, Homo sapiens
ggtgggatgagggattgaagtgg

SEQ ID NO: 28824 - DNA, 21 bp, Homo sapiens
gtgggatgagggattgaagtg

SEQ ID NO: 28825 - DNA, 22 bp, Homo sapiens
gtgggatgagggattgaagtgg

SEQ ID NO: 28826 - DNA, 23 bp, Homo sapiens
gtgggatgagggattgaagtgga

SEQ ID NO: 28827 - DNA, 25 bp, Homo sapiens
gtgggatgagggattgaagtggagc

SEQ ID NO: 28828 - DNA, 16 bp, Homo sapiens
tgggatgagggattga

SEQ ID NO: 28829 - DNA, 19 bp, Homo sapiens
tgggatgagggattgaagt

SEQ ID NO: 28830 - DNA, 21 bp, Homo sapiens
tgggatgagggattgaagtgg

SEQ ID NO: 28831 - DNA, 23 bp, Homo sapiens
tgggatgagggattgaagtggag

SEQ ID NO: 28832 - DNA, 24 bp, Homo sapiens
tgggatgagggattgaagtggagc

SEQ ID NO: 28833 - DNA, 21 bp, Homo sapiens
gggatgagggattgaagtgga

SEQ ID NO: 28834 - DNA, 23 bp, Homo sapiens
gggatgagggattgaagtggagc

SEQ ID NO: 28835 - DNA, 21 bp, Homo sapiens
tccactgaatcctcttttcct

SEQ ID NO: 28836 - DNA, 22 bp, Homo sapiens
tccactgaatcctcttttcctc

SEQ ID NO: 28837 - DNA, 23 bp, Homo sapiens
tccactgaatcctcttttcctca

SEQ ID NO: 28838 - DNA, 24 bp, Homo sapiens
tccactgaatcctcttttcctcag

SEQ ID NO: 28839 - DNA, 22 bp, Homo sapiens
cactgaatcctcttttcctcag

SEQ ID NO: 28840 - DNA, 23 bp, Homo sapiens
cactgaatcctcttttcctcagg

SEQ ID NO: 28841 - DNA, 19 bp, Homo sapiens
actgaatcctcttttcctc

SEQ ID NO: 28842 - DNA, 20 bp, Homo sapiens
actgaatcctcttttcctca

SEQ ID NO: 28843 - DNA, 22 bp, Homo sapiens
actgaatcctcttttcctcagg

SEQ ID NO: 28844 - DNA, 23 bp, Homo sapiens
actgaatcctcttttcctcaggt

SEQ ID NO: 28845 - DNA, 19 bp, Homo sapiens
ggtagggggcgggctccgg

SEQ ID NO: 28846 - DNA, 18 bp, Homo sapiens
gtagggggcgggctccgg

SEQ ID NO: 28847 - DNA, 19 bp, Homo sapiens
gtagggggcgggctccggc

SEQ ID NO: 28848 - DNA, 20 bp, Homo sapiens
gtagggggcgggctccggcg

SEQ ID NO: 28849 - DNA, 18 bp, Homo sapiens
tagggggcgggctccggc

SEQ ID NO: 28850 - DNA, 19 bp, Homo sapiens
agggggcgggctccggcgc

SEQ ID NO: 28851 - DNA, 20 bp, Homo sapiens
agggggcgggctccggcgct

SEQ ID NO: 28852 - DNA, 22 bp, Homo sapiens
agggggcgggctccggcgctgg

SEQ ID NO: 28853 - DNA, 19 bp, Homo sapiens
gggggcgggctccggcgct

SEQ ID NO: 28854 - DNA, 17 bp, Homo sapiens
ggggcgggctccggcgc

SEQ ID NO: 28855 - DNA, 19 bp, Homo sapiens
ggggcgggctccggcgctg

SEQ ID NO: 28856 - DNA, 16 bp, Homo sapiens
ggcgggctccggcgct

SEQ ID NO: 28857 - DNA, 16 bp, Homo sapiens
ggggtctgacccacac

SEQ ID NO: 28858 - DNA, 21 bp, Homo sapiens
ccctcggggtctgacccacac

SEQ ID NO: 28859 - DNA, 22 bp, Homo sapiens
cccctcggggtctgacccacac

SEQ ID NO: 28860 - DNA, 23 bp, Homo sapiens
acccctcggggtctgacccacac

SEQ ID NO: 28861 - DNA, 22 bp, Homo sapiens
ggagatgcgaggacccctcggg

SEQ ID NO: 28862 - DNA, 19 bp, Homo sapiens
ggagatgcgaggacccctc

SEQ ID NO: 28863 - DNA, 18 bp, Homo sapiens
ggagatgcgaggacccct

SEQ ID NO: 28864 - DNA, 17 bp, Homo sapiens
ggagatgcgaggacccc

SEQ ID NO: 28865 - DNA, 16 bp, Homo sapiens
ggagatgcgaggaccc

SEQ ID NO: 28866 - DNA, 26 bp, Homo sapiens
accggccgccggctccgccccggccc

SEQ ID NO: 28867 - DNA, 24 bp, Homo sapiens
ccggccgccggctccgccccggcc

SEQ ID NO: 28868 - DNA, 25 bp, Homo sapiens
accggccgccggctccgccccggcc

SEQ ID NO: 28869 - DNA, 22 bp, Homo sapiens
cggccgccggctccgccccggc

SEQ ID NO: 28870 - DNA, 23 bp, Homo sapiens
ccggccgccggctccgccccggc

SEQ ID NO: 28871 - DNA, 21 bp, Homo sapiens
cggccgccggctccgccccgg

SEQ ID NO: 28872 - DNA, 22 bp, Homo sapiens
ccggccgccggctccgccccgg

SEQ ID NO: 28873 - DNA, 23 bp, Homo sapiens
accggccgccggctccgccccgg

SEQ ID NO: 28874 - DNA, 22 bp, Homo sapiens
accggccgccggctccgccccg

SEQ ID NO: 28875 - DNA, 20 bp, Homo sapiens
ccggccgccggctccgcccc

SEQ ID NO: 28876 - DNA, 21 bp, Homo sapiens
accggccgccggctccgcccc

SEQ ID NO: 28877 - DNA, 20 bp, Homo sapiens
accggccgccggctccgccc

SEQ ID NO: 28878 - DNA, 19 bp, Homo sapiens
accggccgccggctccgcc

SEQ ID NO: 28879 - DNA, 18 bp, Homo sapiens
accggccgccggctccgc

SEQ ID NO: 28880 - DNA, 25 bp, Homo sapiens
cggcggggacggcgattggtccgta

SEQ ID NO: 28881 - DNA, 24 bp, Homo sapiens
cggcggggacggcgattggtccgt

SEQ ID NO: 28882 - DNA, 23 bp, Homo sapiens
cggcggggacggcgattggtccg

SEQ ID NO: 28883 - DNA, 21 bp, Homo sapiens
ggcggggacggcgattggtcc

SEQ ID NO: 28884 - DNA, 22 bp, Homo sapiens
cggcggggacggcgattggtcc

SEQ ID NO: 28885 - DNA, 20 bp, Homo sapiens
cggcggggacggcgattggt

SEQ ID NO: 28886 - DNA, 19 bp, Homo sapiens
cggcggggacggcgattgg

SEQ ID NO: 28887 - DNA, 18 bp, Homo sapiens
cggcggggacggcgattg

SEQ ID NO: 28888 - DNA, 16 bp, Homo sapiens
ggcggggacggcgatt

SEQ ID NO: 28889 - DNA, 17 bp, Homo sapiens
cggcggggacggcgatt

SEQ ID NO: 28890 - DNA, 16 bp, Homo sapiens
cggcggggacggcgat

SEQ ID NO: 28891 - DNA, 26 bp, Homo sapiens
cagccgccgcctgtctccacagtatg

SEQ ID NO: 28892 - DNA, 24 bp, Homo sapiens
cagccgccgcctgtctccacagta

SEQ ID NO: 28893 - DNA, 23 bp, Homo sapiens
cagccgccgcctgtctccacagt

SEQ ID NO: 28894 - DNA, 21 bp, Homo sapiens
agccgccgcctgtctccacag

SEQ ID NO: 28895 - DNA, 21 bp, Homo sapiens
cagccgccgcctgtctccaca

SEQ ID NO: 28896 - DNA, 22 bp, Homo sapiens
ccagccgccgcctgtctccaca

SEQ ID NO: 28897 - DNA, 23 bp, Homo sapiens
tccagccgccgcctgtctccaca

SEQ ID NO: 28898 - DNA, 20 bp, Homo sapiens
cagccgccgcctgtctccac

SEQ ID NO: 28899 - DNA, 21 bp, Homo sapiens
tccagccgccgcctgtctcca

SEQ ID NO: 28900 - DNA, 18 bp, Homo sapiens
cagccgccgcctgtctcc

SEQ ID NO: 28901 - DNA, 21 bp, Homo sapiens
aaggaggtggcctggagagct

SEQ ID NO: 28902 - DNA, 24 bp, Homo sapiens
gggagaaggaggtggcctggagag

SEQ ID NO: 28903 - DNA, 26 bp, Homo sapiens
ccgggagaaggaggtggcctggagag

SEQ ID NO: 28904 - DNA, 27 bp, Homo sapiens
cccgggagaaggaggtggcctggagag

SEQ ID NO: 28905 - DNA, 23 bp, Homo sapiens
gggagaaggaggtggcctggaga

SEQ ID NO: 28906 - DNA, 25 bp, Homo sapiens
ccgggagaaggaggtggcctggaga

SEQ ID NO: 28907 - DNA, 26 bp, Homo sapiens
cccgggagaaggaggtggcctggaga

SEQ ID NO: 28908 - DNA, 22 bp, Homo sapiens
gggagaaggaggtggcctggag

SEQ ID NO: 28909 - DNA, 23 bp, Homo sapiens
cgggagaaggaggtggcctggag

SEQ ID NO: 28910 - DNA, 24 bp, Homo sapiens
ccgggagaaggaggtggcctggag

SEQ ID NO: 28911 - DNA, 25 bp, Homo sapiens
cccgggagaaggaggtggcctggag

SEQ ID NO: 28912 - DNA, 22 bp, Homo sapiens
cgggagaaggaggtggcctgga

SEQ ID NO: 28913 - DNA, 23 bp, Homo sapiens
ccgggagaaggaggtggcctgga

SEQ ID NO: 28914 - DNA, 23 bp, Homo sapiens
cccgggagaaggaggtggcctgg

SEQ ID NO: 28915 - DNA, 19 bp, Homo sapiens
ccgggagaaggaggtggcc

SEQ ID NO: 28916 - DNA, 19 bp, Homo sapiens
tgtgggatctggaggcatc

SEQ ID NO: 28917 - DNA, 20 bp, Homo sapiens
tgtgggatctggaggcatct

SEQ ID NO: 28918 - DNA, 23 bp, Homo sapiens
tgtgggatctggaggcatctggg

SEQ ID NO: 28919 - DNA, 24 bp, Homo sapiens
tgtgggatctggaggcatctgggg

SEQ ID NO: 28920 - DNA, 25 bp, Homo sapiens
tgtgggatctggaggcatctggggt

SEQ ID NO: 28921 - DNA, 26 bp, Homo sapiens
tgtgggatctggaggcatctggggtt

SEQ ID NO: 28922 - DNA, 28 bp, Homo sapiens
tgtgggatctggaggcatctggggttgg

SEQ ID NO: 28923 - DNA, 17 bp, Homo sapiens
tgggatctggaggcatc

SEQ ID NO: 28924 - DNA, 22 bp, Homo sapiens
aaagatgagctcattgtaatat

SEQ ID NO: 28925 - DNA, 17 bp, Homo sapiens
gatgagctcattgtaat

SEQ ID NO: 28926 - DNA, 18 bp, Homo sapiens
gatgagctcattgtaata

SEQ ID NO: 28927 - DNA, 19 bp, Homo sapiens
gatgagctcattgtaatat

SEQ ID NO: 28928 - DNA, 20 bp, Homo sapiens
gatgagctcattgtaatatg

SEQ ID NO: 28929 - DNA, 21 bp, Homo sapiens
gatgagctcattgtaatatga

SEQ ID NO: 28930 - DNA, 23 bp, Homo sapiens
gatgagctcattgtaatatgagc

SEQ ID NO: 28931 - DNA, 22 bp, Homo sapiens
tcatattaccattagctcatct

SEQ ID NO: 28932 - DNA, 20 bp, Homo sapiens
catattaccattagctcatc

SEQ ID NO: 28933 - DNA, 21 bp, Homo sapiens
catattaccattagctcatct

SEQ ID NO: 28934 - DNA, 22 bp, Homo sapiens
catattaccattagctcatctt

SEQ ID NO: 28935 - DNA, 18 bp, Homo sapiens
atattaccattagctcat

SEQ ID NO: 28936 - DNA, 19 bp, Homo sapiens
atattaccattagctcatc

SEQ ID NO: 28937 - DNA, 20 bp, Homo sapiens
atattaccattagctcatct

SEQ ID NO: 28938 - DNA, 21 bp, Homo sapiens
atattaccattagctcatctt

SEQ ID NO: 28939 - DNA, 23 bp, Homo sapiens
atattaccattagctcatctttt

SEQ ID NO: 28940 - DNA, 24 bp, Homo sapiens
atattaccattagctcatcttttt

SEQ ID NO: 28941 - DNA, 22 bp, Homo sapiens
tattaccattagctcatctttt

SEQ ID NO: 28942 - DNA, 25 bp, Homo sapiens
tcctgccttcctctgcaccagctaa

SEQ ID NO: 28943 - DNA, 24 bp, Homo sapiens
tcctgccttcctctgcaccagcta

SEQ ID NO: 28944 - DNA, 22 bp, Homo sapiens
cctgccttcctctgcaccagct

SEQ ID NO: 28945 - DNA, 23 bp, Homo sapiens
tcctgccttcctctgcaccagct

SEQ ID NO: 28946 - DNA, 24 bp, Homo sapiens
ttcctgccttcctctgcaccagct

SEQ ID NO: 28947 - DNA, 21 bp, Homo sapiens
cctgccttcctctgcaccagc

SEQ ID NO: 28948 - DNA, 22 bp, Homo sapiens
tcctgccttcctctgcaccagc

SEQ ID NO: 28949 - DNA, 23 bp, Homo sapiens
ttcctgccttcctctgcaccagc

SEQ ID NO: 28950 - DNA, 20 bp, Homo sapiens
cctgccttcctctgcaccag

SEQ ID NO: 28951 - DNA, 22 bp, Homo sapiens
ttcctgccttcctctgcaccag

SEQ ID NO: 28952 - DNA, 20 bp, Homo sapiens
tcctgccttcctctgcacca

SEQ ID NO: 28953 - DNA, 19 bp, Homo sapiens
tcctgccttcctctgcacc

SEQ ID NO: 28954 - DNA, 20 bp, Homo sapiens
ttcctgccttcctctgcacc

SEQ ID NO: 28955 - DNA, 26 bp, Homo sapiens
aggggtgtggaaagaggcagaacatt

SEQ ID NO: 28956 - DNA, 25 bp, Homo sapiens
gaggggtgtggaaagaggcagaaca

SEQ ID NO: 28957 - DNA, 23 bp, Homo sapiens
aggggtgtggaaagaggcagaac

SEQ ID NO: 28958 - DNA, 22 bp, Homo sapiens
aggggtgtggaaagaggcagaa

SEQ ID NO: 28959 - DNA, 21 bp, Homo sapiens
aggggtgtggaaagaggcaga

SEQ ID NO: 28960 - DNA, 20 bp, Homo sapiens
aggggtgtggaaagaggcag

SEQ ID NO: 28961 - DNA, 18 bp, Homo sapiens
aggggtgtggaaagaggc

SEQ ID NO: 28962 - DNA, 22 bp, Homo sapiens
ttttggaggggtgtggaaagag

SEQ ID NO: 28963 - DNA, 19 bp, Homo sapiens
ttttggaggggtgtggaaa

SEQ ID NO: 28964 - DNA, 18 bp, Homo sapiens
ttttggaggggtgtggaa

SEQ ID NO: 28965 - DNA, 17 bp, Homo sapiens
ttttggaggggtgtgga

SEQ ID NO: 28966 - DNA, 20 bp, Homo sapiens
gtggtgtgtgggtgggaagg

SEQ ID NO: 28967 - DNA, 23 bp, Homo sapiens
tgtgtgggtgggaaggactggat

SEQ ID NO: 28968 - DNA, 24 bp, Homo sapiens
tgtgtgggtgggaaggactggatt

SEQ ID NO: 28969 - DNA, 21 bp, Homo sapiens
gtgtgggtgggaaggactgga

SEQ ID NO: 28970 - DNA, 24 bp, Homo sapiens
gtgtgggtgggaaggactggattt

SEQ ID NO: 28971 - DNA, 20 bp, Homo sapiens
tgtgggtgggaaggactgga

SEQ ID NO: 28972 - DNA, 21 bp, Homo sapiens
tgtgggtgggaaggactggat

SEQ ID NO: 28973 - DNA, 23 bp, Homo sapiens
tgtgggtgggaaggactggattt

SEQ ID NO: 28974 - DNA, 25 bp, Homo sapiens
tgtgggtgggaaggactggatttga

SEQ ID NO: 28975 - DNA, 18 bp, Homo sapiens
tgacgatcctgtccctgt

SEQ ID NO: 28976 - DNA, 19 bp, Homo sapiens
tcctgtccctgtctcctac

SEQ ID NO: 28977 - DNA, 20 bp, Homo sapiens
tcctgtccctgtctcctaca

SEQ ID NO: 28978 - DNA, 22 bp, Homo sapiens
tcctgtccctgtctcctacaga

SEQ ID NO: 28979 - DNA, 23 bp, Homo sapiens
tcctgtccctgtctcctacagac

SEQ ID NO: 28980 - DNA, 24 bp, Homo sapiens
tcctgtccctgtctcctacagacc

SEQ ID NO: 28981 - DNA, 20 bp, Homo sapiens
cctgtccctgtctcctacag

SEQ ID NO: 28982 - DNA, 21 bp, Homo sapiens
cctgtccctgtctcctacaga

SEQ ID NO: 28983 - DNA, 23 bp, Homo sapiens
tgcctgttcttccactccaggtg

SEQ ID NO: 28984 - DNA, 24 bp, Homo sapiens
ctgcctgttcttccactccaggtg

SEQ ID NO: 28985 - DNA, 22 bp, Homo sapiens
tgcctgttcttccactccaggt

SEQ ID NO: 28986 - DNA, 23 bp, Homo sapiens
ctgcctgttcttccactccaggt

SEQ ID NO: 28987 - DNA, 21 bp, Homo sapiens
tgcctgttcttccactccagg

SEQ ID NO: 28988 - DNA, 22 bp, Homo sapiens
ctgcctgttcttccactccagg

SEQ ID NO: 28989 - DNA, 20 bp, Homo sapiens
tgcctgttcttccactccag

SEQ ID NO: 28990 - DNA, 16 bp, Homo sapiens
acagagctgcctgttc

SEQ ID NO: 28991 - DNA, 27 bp, Homo sapiens
atggagtggactttcagctggcattta

SEQ ID NO: 28992 - DNA, 26 bp, Homo sapiens
atggagtggactttcagctggcattt

SEQ ID NO: 28993 - DNA, 27 bp, Homo sapiens
tatggagtggactttcagctggcattt

SEQ ID NO: 28994 - DNA, 24 bp, Homo sapiens
tggagtggactttcagctggcatt

SEQ ID NO: 28995 - DNA, 25 bp, Homo sapiens
atggagtggactttcagctggcatt

SEQ ID NO: 28996 - DNA, 26 bp, Homo sapiens
tatggagtggactttcagctggcatt

SEQ ID NO: 28997 - DNA, 23 bp, Homo sapiens
tggagtggactttcagctggcat

SEQ ID NO: 28998 - DNA, 24 bp, Homo sapiens
atggagtggactttcagctggcat

SEQ ID NO: 28999 - DNA, 22 bp, Homo sapiens
tggagtggactttcagctggca

SEQ ID NO: 29000 - DNA, 23 bp, Homo sapiens
atggagtggactttcagctggca

SEQ ID NO: 29001 - DNA, 24 bp, Homo sapiens
tatggagtggactttcagctggca

SEQ ID NO: 29002 - DNA, 22 bp, Homo sapiens
atggagtggactttcagctggc

SEQ ID NO: 29003 - DNA, 21 bp, Homo sapiens
atggagtggactttcagctgg

SEQ ID NO: 29004 - DNA, 22 bp, Homo sapiens
tatggagtggactttcagctgg

SEQ ID NO: 29005 - DNA, 20 bp, Homo sapiens
atggagtggactttcagctg

SEQ ID NO: 29006 - DNA, 20 bp, Homo sapiens
tatggagtggactttcagct

SEQ ID NO: 29007 - DNA, 17 bp, Homo sapiens
tatggagtggactttca

SEQ ID NO: 29008 - DNA, 16 bp, Homo sapiens
acctcagaccacaacc

SEQ ID NO: 29009 - DNA, 17 bp, Homo sapiens
gacctcagaccacaacc

SEQ ID NO: 29010 - DNA, 18 bp, Homo sapiens
agacctcagaccacaacc

SEQ ID NO: 29011 - DNA, 19 bp, Homo sapiens
aagacctcagaccacaacc

SEQ ID NO: 29012 - DNA, 20 bp, Homo sapiens
caagacctcagaccacaacc

SEQ ID NO: 29013 - DNA, 22 bp, Homo sapiens
cccaagacctcagaccacaacc

SEQ ID NO: 29014 - DNA, 25 bp, Homo sapiens
tggcccaagacctcagaccacaacc

SEQ ID NO: 29015 - DNA, 21 bp, Homo sapiens
cccaagacctcagaccacaac

SEQ ID NO: 29016 - DNA, 22 bp, Homo sapiens
gcccaagacctcagaccacaac

SEQ ID NO: 29017 - DNA, 24 bp, Homo sapiens
tggcccaagacctcagaccacaac

SEQ ID NO: 29018 - DNA, 17 bp, Homo sapiens
aagacctcagaccacaa

SEQ ID NO: 29019 - DNA, 20 bp, Homo sapiens
cccaagacctcagaccacaa

SEQ ID NO: 29020 - DNA, 23 bp, Homo sapiens
tggcccaagacctcagaccacaa

SEQ ID NO: 29021 - DNA, 19 bp, Homo sapiens
cccaagacctcagaccaca

SEQ ID NO: 29022 - DNA, 22 bp, Homo sapiens
tggcccaagacctcagaccaca

SEQ ID NO: 29023 - DNA, 19 bp, Homo sapiens
gcccaagacctcagaccac

SEQ ID NO: 29024 - DNA, 21 bp, Homo sapiens
tggcccaagacctcagaccac

SEQ ID NO: 29025 - DNA, 20 bp, Homo sapiens
tggcccaagacctcagacca

SEQ ID NO: 29026 - DNA, 21 bp, Homo sapiens
atggcccaagacctcagacca

SEQ ID NO: 29027 - DNA, 20 bp, Homo sapiens
atggcccaagacctcagacc

SEQ ID NO: 29028 - DNA, 22 bp, Homo sapiens
tctggggtcttgggccatctgg

SEQ ID NO: 29029 - DNA, 23 bp, Homo sapiens
gtctggggtcttgggccatctgg

SEQ ID NO: 29030 - DNA, 24 bp, Homo sapiens
tggtctggggtcttgggccatctg

SEQ ID NO: 29031 - DNA, 20 bp, Homo sapiens
tctggggtcttgggccatct

SEQ ID NO: 29032 - DNA, 23 bp, Homo sapiens
tggtctggggtcttgggccatct

SEQ ID NO: 29033 - DNA, 22 bp, Homo sapiens
tggtctggggtcttgggccatc

SEQ ID NO: 29034 - DNA, 24 bp, Homo sapiens
tgtggtctggggtcttgggccatc

SEQ ID NO: 29035 - DNA, 21 bp, Homo sapiens
tggtctggggtcttgggccat

SEQ ID NO: 29036 - DNA, 22 bp, Homo sapiens
tgtggtctggggtcttgggcca

SEQ ID NO: 29037 - DNA, 21 bp, Homo sapiens
tgtggtctggggtcttgggcc

SEQ ID NO: 29038 - DNA, 22 bp, Homo sapiens
ttgtggtctggggtcttgggcc

SEQ ID NO: 29039 - DNA, 20 bp, Homo sapiens
tgtggtctggggtcttgggc

SEQ ID NO: 29040 - DNA, 21 bp, Homo sapiens
ttgtggtctggggtcttgggc

SEQ ID NO: 29041 - DNA, 20 bp, Homo sapiens
ttgtggtctggggtcttggg

SEQ ID NO: 29042 - DNA, 16 bp, Homo sapiens
ttgtggtctggggtct

SEQ ID NO: 29043 - DNA, 21 bp, Homo sapiens
gtcccgggggcggggccgaag

SEQ ID NO: 29044 - DNA, 23 bp, Homo sapiens
gtcccgggggcggggccgaagcg

SEQ ID NO: 29045 - DNA, 24 bp, Homo sapiens
gtcccgggggcggggccgaagcgc

SEQ ID NO: 29046 - DNA, 20 bp, Homo sapiens
tcccgggggcggggccgaag

SEQ ID NO: 29047 - DNA, 22 bp, Homo sapiens
tcccgggggcggggccgaagcg

SEQ ID NO: 29048 - DNA, 23 bp, Homo sapiens
tcccgggggcggggccgaagcgc

SEQ ID NO: 29049 - DNA, 24 bp, Homo sapiens
tcccgggggcggggccgaagcgcg

SEQ ID NO: 29050 - DNA, 25 bp, Homo sapiens
tcccgggggcggggccgaagcgcgg

SEQ ID NO: 29051 - DNA, 19 bp, Homo sapiens
cccgggggcggggccgaag

SEQ ID NO: 29052 - DNA, 21 bp, Homo sapiens
cccgggggcggggccgaagcg

SEQ ID NO: 29053 - DNA, 22 bp, Homo sapiens
cccgggggcggggccgaagcgc

SEQ ID NO: 29054 - DNA, 23 bp, Homo sapiens
cccgggggcggggccgaagcgcg

SEQ ID NO: 29055 - DNA, 24 bp, Homo sapiens
cccgggggcggggccgaagcgcgg

SEQ ID NO: 29056 - DNA, 25 bp, Homo sapiens
cccgggggcggggccgaagcgcggc

SEQ ID NO: 29057 - DNA, 20 bp, Homo sapiens
ccgggggcggggccgaagcg

SEQ ID NO: 29058 - DNA, 16 bp, Homo sapiens
tccttctgctccgtcc

SEQ ID NO: 29059 - DNA, 18 bp, Homo sapiens
tccttctgctccgtcccc

SEQ ID NO: 29060 - DNA, 20 bp, Homo sapiens
tccttctgctccgtccccca

SEQ ID NO: 29061 - DNA, 22 bp, Homo sapiens
tccttctgctccgtcccccagg

SEQ ID NO: 29062 - DNA, 23 bp, Homo sapiens
tccttctgctccgtcccccaggc

SEQ ID NO: 29063 - DNA, 24 bp, Homo sapiens
tccttctgctccgtcccccaggct

SEQ ID NO: 29064 - DNA, 20 bp, Homo sapiens
ccttctgctccgtcccccag

SEQ ID NO: 29065 - DNA, 21 bp, Homo sapiens
ccttctgctccgtcccccagg

SEQ ID NO: 29066 - DNA, 22 bp, Homo sapiens
ccttctgctccgtcccccaggc

SEQ ID NO: 29067 - DNA, 23 bp, Homo sapiens
ccttctgctccgtcccccaggct

SEQ ID NO: 29068 - DNA, 25 bp, Homo sapiens
ctgccaattccataggtcacaggta

SEQ ID NO: 29069 - DNA, 24 bp, Homo sapiens
ctgccaattccataggtcacaggt

SEQ ID NO: 29070 - DNA, 23 bp, Homo sapiens
ctgccaattccataggtcacagg

SEQ ID NO: 29071 - DNA, 21 bp, Homo sapiens
ctgccaattccataggtcaca

SEQ ID NO: 29072 - DNA, 22 bp, Homo sapiens
gctgccaattccataggtcaca

SEQ ID NO: 29073 - DNA, 23 bp, Homo sapiens
ggctgccaattccataggtcaca

SEQ ID NO: 29074 - DNA, 19 bp, Homo sapiens
ctgccaattccataggtca

SEQ ID NO: 29075 - DNA, 21 bp, Homo sapiens
ctggctgccaattccataggt

SEQ ID NO: 29076 - DNA, 19 bp, Homo sapiens
ctggctgccaattccatag

SEQ ID NO: 29077 - DNA, 24 bp, Homo sapiens
tgacctatgaattgacagccagtg

SEQ ID NO: 29078 - DNA, 23 bp, Homo sapiens
tgacctatgaattgacagccagt

SEQ ID NO: 29079 - DNA, 24 bp, Homo sapiens
ctgacctatgaattgacagccagt

SEQ ID NO: 29080 - DNA, 22 bp, Homo sapiens
tgacctatgaattgacagccag

SEQ ID NO: 29081 - DNA, 23 bp, Homo sapiens
ctgacctatgaattgacagccag

SEQ ID NO: 29082 - DNA, 21 bp, Homo sapiens
tgacctatgaattgacagcca

SEQ ID NO: 29083 - DNA, 22 bp, Homo sapiens
ctgacctatgaattgacagcca

SEQ ID NO: 29084 - DNA, 20 bp, Homo sapiens
tgacctatgaattgacagcc

SEQ ID NO: 29085 - DNA, 19 bp, Homo sapiens
tgacctatgaattgacagc

SEQ ID NO: 29086 - DNA, 20 bp, Homo sapiens
ctgacctatgaattgacagc

SEQ ID NO: 29087 - DNA, 18 bp, Homo sapiens
ctgacctatgaattgaca

SEQ ID NO: 29088 - DNA, 26 bp, Homo sapiens
ccagtggggctgctgttatctggggc

SEQ ID NO: 29089 - DNA, 23 bp, Homo sapiens
agtggggctgctgttatctgggg

SEQ ID NO: 29090 - DNA, 25 bp, Homo sapiens
ccagtggggctgctgttatctgggg

SEQ ID NO: 29091 - DNA, 23 bp, Homo sapiens
cagtggggctgctgttatctggg

SEQ ID NO: 29092 - DNA, 24 bp, Homo sapiens
ccagtggggctgctgttatctggg

SEQ ID NO: 29093 - DNA, 23 bp, Homo sapiens
ccagtggggctgctgttatctgg

SEQ ID NO: 29094 - DNA, 21 bp, Homo sapiens
ccagtggggctgctgttatct

SEQ ID NO: 29095 - DNA, 20 bp, Homo sapiens
ccagtggggctgctgttatc

SEQ ID NO: 29096 - DNA, 19 bp, Homo sapiens
ccagtggggctgctgttat

SEQ ID NO: 29097 - DNA, 26 bp, Homo sapiens
tgtaacagcaactccatgtggaagtg

SEQ ID NO: 29098 - DNA, 25 bp, Homo sapiens
tgtaacagcaactccatgtggaagt

SEQ ID NO: 29099 - DNA, 23 bp, Homo sapiens
gtaacagcaactccatgtggaag

SEQ ID NO: 29100 - DNA, 24 bp, Homo sapiens
tgtaacagcaactccatgtggaag

SEQ ID NO: 29101 - DNA, 22 bp, Homo sapiens
gtaacagcaactccatgtggaa

SEQ ID NO: 29102 - DNA, 23 bp, Homo sapiens
tgtaacagcaactccatgtggaa

SEQ ID NO: 29103 - DNA, 23 bp, Homo sapiens
ctgtaacagcaactccatgtgga

SEQ ID NO: 29104 - DNA, 21 bp, Homo sapiens
cctgtaacagcaactccatgt

SEQ ID NO: 29105 - DNA, 24 bp, Homo sapiens
gaactcaccctctgctcccagctc

SEQ ID NO: 29106 - DNA, 23 bp, Homo sapiens
gaactcaccctctgctcccagct

SEQ ID NO: 29107 - DNA, 21 bp, Homo sapiens
aactcaccctctgctcccagc

SEQ ID NO: 29108 - DNA, 22 bp, Homo sapiens
gaactcaccctctgctcccagc

SEQ ID NO: 29109 - DNA, 20 bp, Homo sapiens
gaactcaccctctgctccca

SEQ ID NO: 29110 - DNA, 19 bp, Homo sapiens
gaactcaccctctgctccc

SEQ ID NO: 29111 - DNA, 25 bp, Homo sapiens
agggaacagctgggtgagctgctgc

SEQ ID NO: 29112 - DNA, 24 bp, Homo sapiens
agggaacagctgggtgagctgctg

SEQ ID NO: 29113 - DNA, 23 bp, Homo sapiens
agggaacagctgggtgagctgct

SEQ ID NO: 29114 - DNA, 22 bp, Homo sapiens
agggaacagctgggtgagctgc

SEQ ID NO: 29115 - DNA, 23 bp, Homo sapiens
cagggaacagctgggtgagctgc

SEQ ID NO: 29116 - DNA, 21 bp, Homo sapiens
agggaacagctgggtgagctg

SEQ ID NO: 29117 - DNA, 23 bp, Homo sapiens
tcagggaacagctgggtgagctg

SEQ ID NO: 29118 - DNA, 20 bp, Homo sapiens
agggaacagctgggtgagct

SEQ ID NO: 29119 - DNA, 21 bp, Homo sapiens
cagggaacagctgggtgagct

SEQ ID NO: 29120 - DNA, 19 bp, Homo sapiens
agggaacagctgggtgagc

SEQ ID NO: 29121 - DNA, 18 bp, Homo sapiens
agggaacagctgggtgag

SEQ ID NO: 29122 - DNA, 23 bp, Homo sapiens
tcctcccctgcctggcccagctc

SEQ ID NO: 29123 - DNA, 24 bp, Homo sapiens
ctcctcccctgcctggcccagctc

SEQ ID NO: 29124 - DNA, 22 bp, Homo sapiens
tcctcccctgcctggcccagct

SEQ ID NO: 29125 - DNA, 23 bp, Homo sapiens
ctcctcccctgcctggcccagct

SEQ ID NO: 29126 - DNA, 21 bp, Homo sapiens
tcctcccctgcctggcccagc

SEQ ID NO: 29127 - DNA, 22 bp, Homo sapiens
ctcctcccctgcctggcccagc

SEQ ID NO: 29128 - DNA, 25 bp, Homo sapiens
ttgctcctcccctgcctggcccagc

SEQ ID NO: 29129 - DNA, 20 bp, Homo sapiens
ctcctcccctgcctggccca

SEQ ID NO: 29130 - DNA, 20 bp, Homo sapiens
ttgctcctcccctgcctggc

SEQ ID NO: 29131 - DNA, 19 bp, Homo sapiens
ttgctcctcccctgcctgg

SEQ ID NO: 29132 - DNA, 25 bp, Homo sapiens
cgggcctggggttgggggagctctg

SEQ ID NO: 29133 - DNA, 24 bp, Homo sapiens
tcgggcctggggttgggggagctc

SEQ ID NO: 29134 - DNA, 22 bp, Homo sapiens
cgggcctggggttgggggagct

SEQ ID NO: 29135 - DNA, 24 bp, Homo sapiens
ctcgggcctggggttgggggagct

SEQ ID NO: 29136 - DNA, 21 bp, Homo sapiens
cgggcctggggttgggggagc

SEQ ID NO: 29137 - DNA, 20 bp, Homo sapiens
ctcgggcctggggttggggg

SEQ ID NO: 29138 - DNA, 21 bp, Homo sapiens
cagggcagggaaggtgggaga

SEQ ID NO: 29139 - DNA, 23 bp, Homo sapiens
cagggcagggaaggtgggagagg

SEQ ID NO: 29140 - DNA, 23 bp, Homo sapiens
agggcagggaaggtgggagaggg

SEQ ID NO: 29141 - DNA, 21 bp, Homo sapiens
ggcagggaaggtgggagaggg

SEQ ID NO: 29142 - DNA, 22 bp, Homo sapiens
cctcctgtcacccgctccttgc

SEQ ID NO: 29143 - DNA, 24 bp, Homo sapiens
cctcctgtcacccgctccttgccc

SEQ ID NO: 29144 - DNA, 20 bp, Homo sapiens
tcctgtcacccgctccttgc

SEQ ID NO: 29145 - DNA, 24 bp, Homo sapiens
tcctgtcacccgctccttgcccag

SEQ ID NO: 29146 - DNA, 25 bp, Homo sapiens
tcctgtcacccgctccttgcccaga

SEQ ID NO: 29147 - DNA, 26 bp, Homo sapiens
tcctgtcacccgctccttgcccagat

SEQ ID NO: 29148 - DNA, 27 bp, Homo sapiens
tcctgtcacccgctccttgcccagatt

SEQ ID NO: 29149 - DNA, 21 bp, Homo sapiens
cctgtcacccgctccttgccc

SEQ ID NO: 29150 - DNA, 23 bp, Homo sapiens
cctgtcacccgctccttgcccag

SEQ ID NO: 29151 - DNA, 24 bp, Homo sapiens
cctgtcacccgctccttgcccaga

SEQ ID NO: 29152 - DNA, 26 bp, Homo sapiens
cctgtcacccgctccttgcccagatt

SEQ ID NO: 29153 - DNA, 27 bp, Homo sapiens
cctgtcacccgctccttgcccagattc

SEQ ID NO: 29154 - DNA, 22 bp, Homo sapiens
tgtcacccgctccttgcccaga

SEQ ID NO: 29155 - DNA, 23 bp, Homo sapiens
tgtcacccgctccttgcccagat

SEQ ID NO: 29156 - DNA, 24 bp, Homo sapiens
tgtcacccgctccttgcccagatt

SEQ ID NO: 29157 - DNA, 25 bp, Homo sapiens
tgtcacccgctccttgcccagattc

SEQ ID NO: 29158 - DNA, 21 bp, Homo sapiens
gtcacccgctccttgcccaga

SEQ ID NO: 29159 - DNA, 27 bp, Homo sapiens
cagactgagcctctctctctccagcct

SEQ ID NO: 29160 - DNA, 23 bp, Homo sapiens
actgagcctctctctctccagcc

SEQ ID NO: 29161 - DNA, 21 bp, Homo sapiens
ctgagcctctctctctccagc

SEQ ID NO: 29162 - DNA, 22 bp, Homo sapiens
actgagcctctctctctccagc

SEQ ID NO: 29163 - DNA, 24 bp, Homo sapiens
agactgagcctctctctctccagc

SEQ ID NO: 29164 - DNA, 25 bp, Homo sapiens
cagactgagcctctctctctccagc

SEQ ID NO: 29165 - DNA, 26 bp, Homo sapiens
ccagactgagcctctctctctccagc

SEQ ID NO: 29166 - DNA, 23 bp, Homo sapiens
agactgagcctctctctctccag

SEQ ID NO: 29167 - DNA, 24 bp, Homo sapiens
cagactgagcctctctctctccag

SEQ ID NO: 29168 - DNA, 25 bp, Homo sapiens
ccagactgagcctctctctctccag

SEQ ID NO: 29169 - DNA, 26 bp, Homo sapiens
cccagactgagcctctctctctccag

SEQ ID NO: 29170 - DNA, 23 bp, Homo sapiens
cagactgagcctctctctctcca

SEQ ID NO: 29171 - DNA, 21 bp, Homo sapiens
agactgagcctctctctctcc

SEQ ID NO: 29172 - DNA, 22 bp, Homo sapiens
cagactgagcctctctctctcc

SEQ ID NO: 29173 - DNA, 19 bp, Homo sapiens
agactgagcctctctctct

SEQ ID NO: 29174 - DNA, 26 bp, Homo sapiens
ttgggggtgaggttggtgtctggccc

SEQ ID NO: 29175 - DNA, 25 bp, Homo sapiens
ttgggggtgaggttggtgtctggcc

SEQ ID NO: 29176 - DNA, 23 bp, Homo sapiens
tgggggtgaggttggtgtctggc

SEQ ID NO: 29177 - DNA, 22 bp, Homo sapiens
tgggggtgaggttggtgtctgg

SEQ ID NO: 29178 - DNA, 24 bp, Homo sapiens
cttgggggtgaggttggtgtctgg

SEQ ID NO: 29179 - DNA, 22 bp, Homo sapiens
ttgggggtgaggttggtgtctg

SEQ ID NO: 29180 - DNA, 21 bp, Homo sapiens
ttgggggtgaggttggtgtct

SEQ ID NO: 29181 - DNA, 23 bp, Homo sapiens
tcttgggggtgaggttggtgtct

SEQ ID NO: 29182 - DNA, 20 bp, Homo sapiens
ttgggggtgaggttggtgtc

SEQ ID NO: 29183 - DNA, 20 bp, Homo sapiens
tcttgggggtgaggttggtg

SEQ ID NO: 29184 - DNA, 16 bp, Homo sapiens
gaccctgctgggcagg

SEQ ID NO: 29185 - DNA, 18 bp, Homo sapiens
gaccctgctgggcagggc

SEQ ID NO: 29186 - DNA, 20 bp, Homo sapiens
gaccctgctgggcagggctt

SEQ ID NO: 29187 - DNA, 21 bp, Homo sapiens
tgctgggcagggcttctgagc

SEQ ID NO: 29188 - DNA, 28 bp, Homo sapiens
tgctgggcagggcttctgagctccttag

SEQ ID NO: 29189 - DNA, 21 bp, Homo sapiens
gctgggcagggcttctgagct

SEQ ID NO: 29190 - DNA, 24 bp, Homo sapiens
gctgggcagggcttctgagctcct

SEQ ID NO: 29191 - DNA, 21 bp, Homo sapiens
ctgggcagggcttctgagctc

SEQ ID NO: 29192 - DNA, 28 bp, Homo sapiens
ctgggcagggcttctgagctccttagca

SEQ ID NO: 29193 - DNA, 24 bp, Homo sapiens
tgggcagggcttctgagctcctta

SEQ ID NO: 29194 - DNA, 26 bp, Homo sapiens
tgggcagggcttctgagctccttagc

SEQ ID NO: 29195 - DNA, 26 bp, Homo sapiens
gggcagggcttctgagctccttagca

SEQ ID NO: 29196 - DNA, 24 bp, Homo sapiens
agggcttctgagctccttagcact

SEQ ID NO: 29197 - DNA, 22 bp, Homo sapiens
ggcttctgagctccttagcact

SEQ ID NO: 29198 - DNA, 17 bp, Homo sapiens
ctgagctccttagcact

SEQ ID NO: 29199 - DNA, 23 bp, Homo sapiens
gtgagcaggcgaggctgggctga

SEQ ID NO: 29200 - DNA, 25 bp, Homo sapiens
gtgagcaggcgaggctgggctgaac

SEQ ID NO: 29201 - DNA, 20 bp, Homo sapiens
gcaggcgaggctgggctgaa

SEQ ID NO: 29202 - DNA, 20 bp, Homo sapiens
caggcgaggctgggctgaac

SEQ ID NO: 29203 - DNA, 17 bp, Homo sapiens
aggcgaggctgggctga

SEQ ID NO: 29204 - DNA, 19 bp, Homo sapiens
aggcgaggctgggctgaac

SEQ ID NO: 29205 - DNA, 20 bp, Homo sapiens
aggcgaggctgggctgaacc

SEQ ID NO: 29206 - DNA, 19 bp, Homo sapiens
ggcgaggctgggctgaacc

SEQ ID NO: 29207 - DNA, 21 bp, Homo sapiens
ggcgaggctgggctgaacccg

SEQ ID NO: 29208 - DNA, 22 bp, Homo sapiens
ggcgaggctgggctgaacccgt

SEQ ID NO: 29209 - DNA, 23 bp, Homo sapiens
ggcgaggctgggctgaacccgtg

SEQ ID NO: 29210 - DNA, 18 bp, Homo sapiens
gcgaggctgggctgaacc

SEQ ID NO: 29211 - DNA, 21 bp, Homo sapiens
gcgaggctgggctgaacccgt

SEQ ID NO: 29212 - DNA, 22 bp, Homo sapiens
gcgaggctgggctgaacccgtg

SEQ ID NO: 29213 - DNA, 16 bp, Homo sapiens
cgaggctgggctgaac

SEQ ID NO: 29214 - DNA, 19 bp, Homo sapiens
cgaggctgggctgaacccg

SEQ ID NO: 29215 - DNA, 16 bp, Homo sapiens
aggagtgcagcccagc

SEQ ID NO: 29216 - DNA, 21 bp, Homo sapiens
tgcagcccagctgaggcctct

SEQ ID NO: 29217 - DNA, 22 bp, Homo sapiens
tgcagcccagctgaggcctctg

SEQ ID NO: 29218 - DNA, 23 bp, Homo sapiens
tgcagcccagctgaggcctctgc

SEQ ID NO: 29219 - DNA, 24 bp, Homo sapiens
tgcagcccagctgaggcctctgct

SEQ ID NO: 29220 - DNA, 25 bp, Homo sapiens
tgcagcccagctgaggcctctgctg

SEQ ID NO: 29221 - DNA, 17 bp, Homo sapiens
gcagcccagctgaggcc

SEQ ID NO: 29222 - DNA, 18 bp, Homo sapiens
gcagcccagctgaggcct

SEQ ID NO: 29223 - DNA, 19 bp, Homo sapiens
gcagcccagctgaggcctc

SEQ ID NO: 29224 - DNA, 20 bp, Homo sapiens
gcagcccagctgaggcctct

SEQ ID NO: 29225 - DNA, 22 bp, Homo sapiens
gcagcccagctgaggcctctgc

SEQ ID NO: 29226 - DNA, 23 bp, Homo sapiens
gcagcccagctgaggcctctgct

SEQ ID NO: 29227 - DNA, 24 bp, Homo sapiens
gcagcccagctgaggcctctgctg

SEQ ID NO: 29228 - DNA, 25 bp, Homo sapiens
gcagcccagctgaggcctctgctgt

SEQ ID NO: 29229 - DNA, 26 bp, Homo sapiens
gcagcccagctgaggcctctgctgtc

SEQ ID NO: 29230 - DNA, 23 bp, Homo sapiens
gggggtggggctagtgatgcagg

SEQ ID NO: 29231 - DNA, 19 bp, Homo sapiens
tggggctagtgatgcagga

SEQ ID NO: 29232 - DNA, 20 bp, Homo sapiens
tggggctagtgatgcaggac

SEQ ID NO: 29233 - DNA, 22 bp, Homo sapiens
tggggctagtgatgcaggacgc

SEQ ID NO: 29234 - DNA, 23 bp, Homo sapiens
tggggctagtgatgcaggacgct

SEQ ID NO: 29235 - DNA, 19 bp, Homo sapiens
gggctagtgatgcaggacg

SEQ ID NO: 29236 - DNA, 17 bp, Homo sapiens
gatgcaggacgctgggg

SEQ ID NO: 29237 - DNA, 18 bp, Homo sapiens
actgtatttaagaaaaca

SEQ ID NO: 29238 - DNA, 19 bp, Homo sapiens
actgtatttaagaaaacac

SEQ ID NO: 29239 - DNA, 20 bp, Homo sapiens
actgtatttaagaaaacacc

SEQ ID NO: 29240 - DNA, 21 bp, Homo sapiens
actgtatttaagaaaacacca

SEQ ID NO: 29241 - DNA, 23 bp, Homo sapiens
actgtatttaagaaaacaccatg

SEQ ID NO: 29242 - DNA, 23 bp, Homo sapiens
tgtatttaagaaaacaccatgga

SEQ ID NO: 29243 - DNA, 21 bp, Homo sapiens
aaaacaccatggagatgaaat

SEQ ID NO: 29244 - DNA, 20 bp, Homo sapiens
aacaccatggagatgaaatg

SEQ ID NO: 29245 - DNA, 19 bp, Homo sapiens
acaccatggagatgaaatg

SEQ ID NO: 29246 - DNA, 18 bp, Homo sapiens
caccatggagatgaaatg

SEQ ID NO: 29247 - DNA, 16 bp, Homo sapiens
ccatggagatgaaatg

SEQ ID NO: 29248 - DNA, 19 bp, Homo sapiens
agaaccaggattcagactc

SEQ ID NO: 29249 - DNA, 22 bp, Homo sapiens
gacagaaccaggattcagactc

SEQ ID NO: 29250 - DNA, 22 bp, Homo sapiens
tgagggacagaaccaggattca

SEQ ID NO: 29251 - DNA, 23 bp, Homo sapiens
tataaaatgagggcagtaagacc

SEQ ID NO: 29252 - DNA, 19 bp, Homo sapiens
aaaatgagggcagtaagac

SEQ ID NO: 29253 - DNA, 21 bp, Homo sapiens
tataaaatgagggcagtaaga

SEQ ID NO: 29254 - DNA, 20 bp, Homo sapiens
tataaaatgagggcagtaag

SEQ ID NO: 29255 - DNA, 20 bp, Homo sapiens
aactgggcagggctgtggtg

SEQ ID NO: 29256 - DNA, 23 bp, Homo sapiens
aactgggcagggctgtggtgagt

SEQ ID NO: 29257 - DNA, 20 bp, Homo sapiens
actgggcagggctgtggtga

SEQ ID NO: 29258 - DNA, 21 bp, Homo sapiens
actgggcagggctgtggtgag

SEQ ID NO: 29259 - DNA, 21 bp, Homo sapiens
ctgggcagggctgtggtgagt

SEQ ID NO: 29260 - DNA, 23 bp, Homo sapiens
ctgggcagggctgtggtgagtga

SEQ ID NO: 29261 - DNA, 21 bp, Homo sapiens
tgggcagggctgtggtgagtg

SEQ ID NO: 29262 - DNA, 23 bp, Homo sapiens
tggaggggggtgtggagccaggg

SEQ ID NO: 29263 - DNA, 24 bp, Homo sapiens
gaggggggtgtggagccagggggc

SEQ ID NO: 29264 - DNA, 23 bp, Homo sapiens
aggggggtgtggagccagggggc

SEQ ID NO: 29265 - DNA, 24 bp, Homo sapiens
aggggggtgtggagccagggggcc

SEQ ID NO: 29266 - DNA, 21 bp, Homo sapiens
gggggtgtggagccagggggc

SEQ ID NO: 29267 - DNA, 20 bp, Homo sapiens
ccgctccctgcccccatact

SEQ ID NO: 29268 - DNA, 21 bp, Homo sapiens
ccgctccctgcccccatactc

SEQ ID NO: 29269 - DNA, 22 bp, Homo sapiens
tccctgcccccatactcccagg

SEQ ID NO: 29270 - DNA, 23 bp, Homo sapiens
tccctgcccccatactcccagga

SEQ ID NO: 29271 - DNA, 24 bp, Homo sapiens
tccctgcccccatactcccaggaa

SEQ ID NO: 29272 - DNA, 21 bp, Homo sapiens
ccctgcccccatactcccagg

SEQ ID NO: 29273 - DNA, 23 bp, Homo sapiens
gctccagggagacagtgtgtgag

SEQ ID NO: 29274 - DNA, 22 bp, Homo sapiens
ctccagggagacagtgtgtgag

SEQ ID NO: 29275 - DNA, 23 bp, Homo sapiens
ctccagggagacagtgtgtgagg

SEQ ID NO: 29276 - DNA, 24 bp, Homo sapiens
ctccagggagacagtgtgtgaggc

SEQ ID NO: 29277 - DNA, 25 bp, Homo sapiens
ctccagggagacagtgtgtgaggcc

SEQ ID NO: 29278 - DNA, 22 bp, Homo sapiens
tccagggagacagtgtgtgagg

SEQ ID NO: 29279 - DNA, 23 bp, Homo sapiens
tccagggagacagtgtgtgaggc

SEQ ID NO: 29280 - DNA, 24 bp, Homo sapiens
tccagggagacagtgtgtgaggcc

SEQ ID NO: 29281 - DNA, 25 bp, Homo sapiens
tccagggagacagtgtgtgaggcct

SEQ ID NO: 29282 - DNA, 26 bp, Homo sapiens
tccagggagacagtgtgtgaggcctc

SEQ ID NO: 29283 - DNA, 20 bp, Homo sapiens
ccagggagacagtgtgtgag

SEQ ID NO: 29284 - DNA, 21 bp, Homo sapiens
ccagggagacagtgtgtgagg

SEQ ID NO: 29285 - DNA, 22 bp, Homo sapiens
ccagggagacagtgtgtgaggc

SEQ ID NO: 29286 - DNA, 23 bp, Homo sapiens
ccagggagacagtgtgtgaggcc

SEQ ID NO: 29287 - DNA, 21 bp, Homo sapiens
cagggagacagtgtgtgaggc

SEQ ID NO: 29288 - DNA, 22 bp, Homo sapiens
cagggagacagtgtgtgaggcc

SEQ ID NO: 29289 - DNA, 23 bp, Homo sapiens
ccatggcctccctgcccgcctct

SEQ ID NO: 29290 - DNA, 21 bp, Homo sapiens
cctccctgcccgcctctctgc

SEQ ID NO: 29291 - DNA, 22 bp, Homo sapiens
cctccctgcccgcctctctgca

SEQ ID NO: 29292 - DNA, 21 bp, Homo sapiens
ctccctgcccgcctctctgca

SEQ ID NO: 29293 - DNA, 23 bp, Homo sapiens
ctccctgcccgcctctctgcaga

SEQ ID NO: 29294 - DNA, 19 bp, Homo sapiens
tccctgcccgcctctctgc

SEQ ID NO: 29295 - DNA, 20 bp, Homo sapiens
tccctgcccgcctctctgca

SEQ ID NO: 29296 - DNA, 21 bp, Homo sapiens
tccctgcccgcctctctgcag

SEQ ID NO: 29297 - DNA, 22 bp, Homo sapiens
tccctgcccgcctctctgcaga

SEQ ID NO: 29298 - DNA, 23 bp, Homo sapiens
tccctgcccgcctctctgcagag

SEQ ID NO: 29299 - DNA, 24 bp, Homo sapiens
tccctgcccgcctctctgcagagt

SEQ ID NO: 29300 - DNA, 26 bp, Homo sapiens
tcccaggtcctccaggccatgagctg

SEQ ID NO: 29301 - DNA, 26 bp, Homo sapiens
aggtcctccaggccatgagctgcggc

SEQ ID NO: 29302 - DNA, 22 bp, Homo sapiens
tccagccacggactgagagtgc

SEQ ID NO: 29303 - DNA, 23 bp, Homo sapiens
tccagccacggactgagagtgca

SEQ ID NO: 29304 - DNA, 24 bp, Homo sapiens
tccagccacggactgagagtgcat

SEQ ID NO: 29305 - DNA, 21 bp, Homo sapiens
ccagccacggactgagagtgc

SEQ ID NO: 29306 - DNA, 22 bp, Homo sapiens
ccagccacggactgagagtgca

SEQ ID NO: 29307 - DNA, 24 bp, Homo sapiens
ccagccacggactgagagtgcata

SEQ ID NO: 29308 - DNA, 22 bp, Homo sapiens
gccacggactgagagtgcatag

SEQ ID NO: 29309 - DNA, 23 bp, Homo sapiens
ccaccagggcagagcagggctga

SEQ ID NO: 29310 - DNA, 24 bp, Homo sapiens
ccaccagggcagagcagggctgat

SEQ ID NO: 29311 - DNA, 25 bp, Homo sapiens
ccaccagggcagagcagggctgatc

SEQ ID NO: 29312 - DNA, 26 bp, Homo sapiens
ccaccagggcagagcagggctgatca

SEQ ID NO: 29313 - DNA, 23 bp, Homo sapiens
caccagggcagagcagggctgat

SEQ ID NO: 29314 - DNA, 20 bp, Homo sapiens
tggtctgtctctgccctggc

SEQ ID NO: 29315 - DNA, 21 bp, Homo sapiens
tggtctgtctctgccctggca

SEQ ID NO: 29316 - DNA, 23 bp, Homo sapiens
tggtctgtctctgccctggcacc

SEQ ID NO: 29317 - DNA, 26 bp, Homo sapiens
tggtctgtctctgccctggcacccag

SEQ ID NO: 29318 - DNA, 24 bp, Homo sapiens
tctgtctctgccctggcacccaga

SEQ ID NO: 29319 - DNA, 25 bp, Homo sapiens
tctgtctctgccctggcacccagat

SEQ ID NO: 29320 - DNA, 24 bp, Homo sapiens
cggatgagcaaagaaagtggtttg

SEQ ID NO: 29321 - DNA, 26 bp, Homo sapiens
cggatgagcaaagaaagtggtttgcg

SEQ ID NO: 29322 - DNA, 27 bp, Homo sapiens
cggatgagcaaagaaagtggtttgcgc

SEQ ID NO: 29323 - DNA, 26 bp, Homo sapiens
aactgtgactttaagggaaatggcgc

SEQ ID NO: 29324 - DNA, 22 bp, Homo sapiens
ctgtgactttaagggaaatggc

SEQ ID NO: 29325 - DNA, 24 bp, Homo sapiens
ctgtgactttaagggaaatggcgc

SEQ ID NO: 29326 - DNA, 20 bp, Homo sapiens
tgtgactttaagggaaatgg

SEQ ID NO: 29327 - DNA, 21 bp, Homo sapiens
tgtgactttaagggaaatggc

SEQ ID NO: 29328 - DNA, 23 bp, Homo sapiens
tgtgactttaagggaaatggcgc

SEQ ID NO: 29329 - DNA, 21 bp, Homo sapiens
gtgactttaagggaaatggcg

SEQ ID NO: 29330 - DNA, 20 bp, Homo sapiens
tgactttaagggaaatggcg

SEQ ID NO: 29331 - DNA, 19 bp, Homo sapiens
gactttaagggaaatggcg

SEQ ID NO: 29332 - DNA, 18 bp, Homo sapiens
actttaagggaaatggcg

SEQ ID NO: 29333 - DNA, 23 bp, Homo sapiens
tctggcttttaactttgatggca

SEQ ID NO: 29334 - DNA, 23 bp, Homo sapiens
gtgcaaaagtacttgcggatttt

SEQ ID NO: 29335 - DNA, 21 bp, Homo sapiens
caaaagtacttgcggattttg

SEQ ID NO: 29336 - DNA, 22 bp, Homo sapiens
caaaagtacttgcggattttgc

SEQ ID NO: 29337 - DNA, 23 bp, Homo sapiens
caaaagtacttgcggattttgct

SEQ ID NO: 29338 - DNA, 20 bp, Homo sapiens
aaaagtacttgcggattttg

SEQ ID NO: 29339 - DNA, 21 bp, Homo sapiens
aaaagtacttgcggattttgc

SEQ ID NO: 29340 - DNA, 23 bp, Homo sapiens
aaaagtacttgcggattttgctt

SEQ ID NO: 29341 - DNA, 24 bp, Homo sapiens
aaaagtacttgcggattttgcttt

SEQ ID NO: 29342 - DNA, 25 bp, Homo sapiens
aaaagtacttgcggattttgcttta

SEQ ID NO: 29343 - DNA, 26 bp, Homo sapiens
aaaagtacttgcggattttgctttac

SEQ ID NO: 29344 - DNA, 27 bp, Homo sapiens
aaaagtacttgcggattttgctttact

SEQ ID NO: 29345 - DNA, 19 bp, Homo sapiens
agtacttgcggattttgct

SEQ ID NO: 29346 - DNA, 25 bp, Homo sapiens
caggagtaaagacagagttccctac

SEQ ID NO: 29347 - DNA, 23 bp, Homo sapiens
aggagtaaagacagagttcccta

SEQ ID NO: 29348 - DNA, 24 bp, Homo sapiens
caggagtaaagacagagttcccta

SEQ ID NO: 29349 - DNA, 25 bp, Homo sapiens
tcaggagtaaagacagagttcccta

SEQ ID NO: 29350 - DNA, 27 bp, Homo sapiens
tctcaggagtaaagacagagttcccta

SEQ ID NO: 29351 - DNA, 20 bp, Homo sapiens
gagtaaagacagagttccct

SEQ ID NO: 29352 - DNA, 22 bp, Homo sapiens
aggagtaaagacagagttccct

SEQ ID NO: 29353 - DNA, 23 bp, Homo sapiens
caggagtaaagacagagttccct

SEQ ID NO: 29354 - DNA, 22 bp, Homo sapiens
caggagtaaagacagagttccc

SEQ ID NO: 29355 - DNA, 23 bp, Homo sapiens
tcaggagtaaagacagagttccc

SEQ ID NO: 29356 - DNA, 21 bp, Homo sapiens
caggagtaaagacagagttcc

SEQ ID NO: 29357 - DNA, 22 bp, Homo sapiens
tcaggagtaaagacagagttcc

SEQ ID NO: 29358 - DNA, 20 bp, Homo sapiens
caggagtaaagacagagttc

SEQ ID NO: 29359 - DNA, 21 bp, Homo sapiens
tcaggagtaaagacagagttc

SEQ ID NO: 29360 - DNA, 23 bp, Homo sapiens
tctcaggagtaaagacagagttc

SEQ ID NO: 29361 - DNA, 24 bp, Homo sapiens
ctctcaggagtaaagacagagttc

SEQ ID NO: 29362 - DNA, 20 bp, Homo sapiens
tcaggagtaaagacagagtt

SEQ ID NO: 29363 - DNA, 21 bp, Homo sapiens
tctcaggagtaaagacagagt

SEQ ID NO: 29364 - DNA, 18 bp, Homo sapiens
tcaggagtaaagacagag

SEQ ID NO: 29365 - DNA, 21 bp, Homo sapiens
ctctcaggagtaaagacagag

SEQ ID NO: 29366 - DNA, 19 bp, Homo sapiens
tctcaggagtaaagacaga

SEQ ID NO: 29367 - DNA, 18 bp, Homo sapiens
tctcaggagtaaagacag

SEQ ID NO: 29368 - DNA, 25 bp, Homo sapiens
tctgtcttcactcatgagtaccttc

SEQ ID NO: 29369 - DNA, 22 bp, Homo sapiens
tctgtcttcactcatgagtacc

SEQ ID NO: 29370 - DNA, 25 bp, Homo sapiens
aactctgtcttcactcatgagtacc

SEQ ID NO: 29371 - DNA, 21 bp, Homo sapiens
tctgtcttcactcatgagtac

SEQ ID NO: 29372 - DNA, 22 bp, Homo sapiens
ctctgtcttcactcatgagtac

SEQ ID NO: 29373 - DNA, 23 bp, Homo sapiens
actctgtcttcactcatgagtac

SEQ ID NO: 29374 - DNA, 23 bp, Homo sapiens
aactctgtcttcactcatgagta

SEQ ID NO: 29375 - DNA, 24 bp, Homo sapiens
gaactctgtcttcactcatgagta

SEQ ID NO: 29376 - DNA, 21 bp, Homo sapiens
actctgtcttcactcatgagt

SEQ ID NO: 29377 - DNA, 21 bp, Homo sapiens
aactctgtcttcactcatgag

SEQ ID NO: 29378 - DNA, 22 bp, Homo sapiens
gaactctgtcttcactcatgag

SEQ ID NO: 29379 - DNA, 23 bp, Homo sapiens
ggaactctgtcttcactcatgag

SEQ ID NO: 29380 - DNA, 20 bp, Homo sapiens
aactctgtcttcactcatga

SEQ ID NO: 29381 - DNA, 21 bp, Homo sapiens
gaactctgtcttcactcatga

SEQ ID NO: 29382 - DNA, 27 bp, Homo sapiens
ttaggccgcagatctgggtgaaatgtc

SEQ ID NO: 29383 - DNA, 26 bp, Homo sapiens
ttaggccgcagatctgggtgaaatgt

SEQ ID NO: 29384 - DNA, 25 bp, Homo sapiens
ttaggccgcagatctgggtgaaatg

SEQ ID NO: 29385 - DNA, 24 bp, Homo sapiens
ttaggccgcagatctgggtgaaat

SEQ ID NO: 29386 - DNA, 21 bp, Homo sapiens
tttcacccagatctgcggcct

SEQ ID NO: 29387 - DNA, 23 bp, Homo sapiens
ttaggccgcagatctgggtgaaa

SEQ ID NO: 29388 - DNA, 22 bp, Homo sapiens
ttaggccgcagatctgggtgaa

SEQ ID NO: 29389 - DNA, 20 bp, Homo sapiens
taggccgcagatctgggtga

SEQ ID NO: 29390 - DNA, 22 bp, Homo sapiens
attaggccgcagatctgggtga

SEQ ID NO: 29391 - DNA, 22 bp, Homo sapiens
tcacccagatctgcggcctaat

SEQ ID NO: 29392 - DNA, 23 bp, Homo sapiens
tcacccagatctgcggcctaatc

SEQ ID NO: 29393 - DNA, 20 bp, Homo sapiens
ttaggccgcagatctgggtg

SEQ ID NO: 29394 - DNA, 20 bp, Homo sapiens
cacccagatctgcggcctaa

SEQ ID NO: 29395 - DNA, 22 bp, Homo sapiens
cacccagatctgcggcctaatc

SEQ ID NO: 29396 - DNA, 19 bp, Homo sapiens
ttaggccgcagatctgggt

SEQ ID NO: 29397 - DNA, 18 bp, Homo sapiens
ttaggccgcagatctggg

SEQ ID NO: 29398 - DNA, 20 bp, Homo sapiens
aataggccacggatctgggc

SEQ ID NO: 29399 - DNA, 21 bp, Homo sapiens
aataggccacggatctgggca

SEQ ID NO: 29400 - DNA, 23 bp, Homo sapiens
aataggccacggatctgggcaaa

SEQ ID NO: 29401 - DNA, 26 bp, Homo sapiens
aataggccacggatctgggcaaaatg

SEQ ID NO: 29402 - DNA, 18 bp, Homo sapiens
ataggccacggatctggg

SEQ ID NO: 29403 - DNA, 19 bp, Homo sapiens
ataggccacggatctgggc

SEQ ID NO: 29404 - DNA, 22 bp, Homo sapiens
ataggccacggatctgggcaaa

SEQ ID NO: 29405 - DNA, 25 bp, Homo sapiens
ataggccacggatctgggcaaaatg

SEQ ID NO: 29406 - DNA, 18 bp, Homo sapiens
ccagggaggctggtttgg

SEQ ID NO: 29407 - DNA, 19 bp, Homo sapiens
ccagggaggctggtttgga

SEQ ID NO: 29408 - DNA, 20 bp, Homo sapiens
ccagggaggctggtttggag

SEQ ID NO: 29409 - DNA, 21 bp, Homo sapiens
ccagggaggctggtttggagg

SEQ ID NO: 29410 - DNA, 23 bp, Homo sapiens
ccagggaggctggtttggaggag

SEQ ID NO: 29411 - DNA, 24 bp, Homo sapiens
ccagggaggctggtttggaggagt

SEQ ID NO: 29412 - DNA, 25 bp, Homo sapiens
ccagggaggctggtttggaggagtc

SEQ ID NO: 29413 - DNA, 24 bp, Homo sapiens
ctgttctcttcacctgcctctgcc

SEQ ID NO: 29414 - DNA, 25 bp, Homo sapiens
tctcttcacctgcctctgcctgcag

SEQ ID NO: 29415 - DNA, 26 bp, Homo sapiens
tctcttcacctgcctctgcctgcagc

SEQ ID NO: 29416 - DNA, 21 bp, Homo sapiens
tcttcacctgcctctgcctgc

SEQ ID NO: 29417 - DNA, 23 bp, Homo sapiens
tcttcacctgcctctgcctgcag

SEQ ID NO: 29418 - DNA, 24 bp, Homo sapiens
tcttcacctgcctctgcctgcagc

SEQ ID NO: 29419 - DNA, 21 bp, Homo sapiens
cttcacctgcctctgcctgca

SEQ ID NO: 29420 - DNA, 22 bp, Homo sapiens
cttcacctgcctctgcctgcag

SEQ ID NO: 29421 - DNA, 23 bp, Homo sapiens
cttcacctgcctctgcctgcagc

SEQ ID NO: 29422 - DNA, 24 bp, Homo sapiens
aggtggatgcaatgtgacctcaac

SEQ ID NO: 29423 - DNA, 23 bp, Homo sapiens
aggtggatgcaatgtgacctcaa

SEQ ID NO: 29424 - DNA, 19 bp, Homo sapiens
tggatgcaatgtgacctca

SEQ ID NO: 29425 - DNA, 20 bp, Homo sapiens
gtggatgcaatgtgacctca

SEQ ID NO: 29426 - DNA, 21 bp, Homo sapiens
ggtggatgcaatgtgacctca

SEQ ID NO: 29427 - DNA, 20 bp, Homo sapiens
ggtggatgcaatgtgacctc

SEQ ID NO: 29428 - DNA, 21 bp, Homo sapiens
aggtggatgcaatgtgacctc

SEQ ID NO: 29429 - DNA, 22 bp, Homo sapiens
aaggtggatgcaatgtgacctc

SEQ ID NO: 29430 - DNA, 23 bp, Homo sapiens
caaggtggatgcaatgtgacctc

SEQ ID NO: 29431 - DNA, 20 bp, Homo sapiens
aggtggatgcaatgtgacct

SEQ ID NO: 29432 - DNA, 21 bp, Homo sapiens
aaggtggatgcaatgtgacct

SEQ ID NO: 29433 - DNA, 22 bp, Homo sapiens
caaggtggatgcaatgtgacct

SEQ ID NO: 29434 - DNA, 20 bp, Homo sapiens
aaggtggatgcaatgtgacc

SEQ ID NO: 29435 - DNA, 21 bp, Homo sapiens
caaggtggatgcaatgtgacc

SEQ ID NO: 29436 - DNA, 20 bp, Homo sapiens
caaggtggatgcaatgtgac

SEQ ID NO: 29437 - DNA, 19 bp, Homo sapiens
caaggtggatgcaatgtga

SEQ ID NO: 29438 - DNA, 18 bp, Homo sapiens
caaggtggatgcaatgtg

SEQ ID NO: 29439 - DNA, 22 bp, Homo sapiens
tctaaggaactcccccaaactg

SEQ ID NO: 29440 - DNA, 26 bp, Homo sapiens
atggggcttctgtagagatttctatg

SEQ ID NO: 29441 - DNA, 23 bp, Homo sapiens
atggggcttctgtagagatttct

SEQ ID NO: 29442 - DNA, 22 bp, Homo sapiens
atggggcttctgtagagatttc

SEQ ID NO: 29443 - DNA, 21 bp, Homo sapiens
atggggcttctgtagagattt

SEQ ID NO: 29444 - DNA, 22 bp, Homo sapiens
tatggggcttctgtagagattt

SEQ ID NO: 29445 - DNA, 20 bp, Homo sapiens
atggggcttctgtagagatt

SEQ ID NO: 29446 - DNA, 21 bp, Homo sapiens
tatggggcttctgtagagatt

SEQ ID NO: 29447 - DNA, 22 bp, Homo sapiens
ttatggggcttctgtagagatt

SEQ ID NO: 29448 - DNA, 19 bp, Homo sapiens
atggggcttctgtagagat

SEQ ID NO: 29449 - DNA, 24 bp, Homo sapiens
acagcaggcacagacaggcagtca

SEQ ID NO: 29450 - DNA, 22 bp, Homo sapiens
gactgcctgtctgtgcctgctg

SEQ ID NO: 29451 - DNA, 23 bp, Homo sapiens
acagcaggcacagacaggcagtc

SEQ ID NO: 29452 - DNA, 24 bp, Homo sapiens
tacagcaggcacagacaggcagtc

SEQ ID NO: 29453 - DNA, 25 bp, Homo sapiens
gtacagcaggcacagacaggcagtc

SEQ ID NO: 29454 - DNA, 22 bp, Homo sapiens
actgcctgtctgtgcctgctgt

SEQ ID NO: 29455 - DNA, 23 bp, Homo sapiens
tacagcaggcacagacaggcagt

SEQ ID NO: 29456 - DNA, 21 bp, Homo sapiens
acagcaggcacagacaggcag

SEQ ID NO: 29457 - DNA, 22 bp, Homo sapiens
tacagcaggcacagacaggcag

SEQ ID NO: 29458 - DNA, 22 bp, Homo sapiens
ctgcctgtctgtgcctgctgta

SEQ ID NO: 29459 - DNA, 23 bp, Homo sapiens
gtacagcaggcacagacaggcag

SEQ ID NO: 29460 - DNA, 24 bp, Homo sapiens
ctgcctgtctgtgcctgctgtaca

SEQ ID NO: 29461 - DNA, 20 bp, Homo sapiens
acagcaggcacagacaggca

SEQ ID NO: 29462 - DNA, 21 bp, Homo sapiens
tacagcaggcacagacaggca

SEQ ID NO: 29463 - DNA, 22 bp, Homo sapiens
tgcctgtctgtgcctgctgtac

SEQ ID NO: 29464 - DNA, 20 bp, Homo sapiens
tacagcaggcacagacaggc

SEQ ID NO: 29465 - DNA, 19 bp, Homo sapiens
tacagcaggcacagacagg

SEQ ID NO: 29466 - DNA, 20 bp, Homo sapiens
gtacagcaggcacagacagg

SEQ ID NO: 29467 - DNA, 20 bp, Homo sapiens
cctgtctgtgcctgctgtac

SEQ ID NO: 29468 - DNA, 22 bp, Homo sapiens
cctgtctgtgcctgctgtacag

SEQ ID NO: 29469 - DNA, 23 bp, Homo sapiens
cctgtctgtgcctgctgtacagg

SEQ ID NO: 29470 - DNA, 24 bp, Homo sapiens
cctgtctgtgcctgctgtacaggt

SEQ ID NO: 29471 - DNA, 25 bp, Homo sapiens
cctgtctacacttgctgtgcagaac

SEQ ID NO: 29472 - DNA, 23 bp, Homo sapiens
gcctgtctacacttgctgtgcag

SEQ ID NO: 29473 - DNA, 24 bp, Homo sapiens
tgcctgtctacacttgctgtgcag

SEQ ID NO: 29474 - DNA, 22 bp, Homo sapiens
gcctgtctacacttgctgtgca

SEQ ID NO: 29475 - DNA, 23 bp, Homo sapiens
tgcctgtctacacttgctgtgca

SEQ ID NO: 29476 - DNA, 21 bp, Homo sapiens
gcctgtctacacttgctgtgc

SEQ ID NO: 29477 - DNA, 21 bp, Homo sapiens
gcacagcaagtgtagacaggc

SEQ ID NO: 29478 - DNA, 22 bp, Homo sapiens
gcacagcaagtgtagacaggca

SEQ ID NO: 29479 - DNA, 23 bp, Homo sapiens
gcacagcaagtgtagacaggcag

SEQ ID NO: 29480 - DNA, 24 bp, Homo sapiens
gcacagcaagtgtagacaggcaga

SEQ ID NO: 29481 - DNA, 19 bp, Homo sapiens
cacagcaagtgtagacagg

SEQ ID NO: 29482 - DNA, 20 bp, Homo sapiens
gcctgtctacacttgctgtg

SEQ ID NO: 29483 - DNA, 20 bp, Homo sapiens
cacagcaagtgtagacaggc

SEQ ID NO: 29484 - DNA, 21 bp, Homo sapiens
tgcctgtctacacttgctgtg

SEQ ID NO: 29485 - DNA, 22 bp, Homo sapiens
cacagcaagtgtagacaggcag

SEQ ID NO: 29486 - DNA, 23 bp, Homo sapiens
cacagcaagtgtagacaggcaga

SEQ ID NO: 29487 - DNA, 24 bp, Homo sapiens
cacagcaagtgtagacaggcagac

SEQ ID NO: 29488 - DNA, 20 bp, Homo sapiens
tgcctgtctacacttgctgt

SEQ ID NO: 29489 - DNA, 20 bp, Homo sapiens
acagcaagtgtagacaggca

SEQ ID NO: 29490 - DNA, 21 bp, Homo sapiens
acagcaagtgtagacaggcag

SEQ ID NO: 29491 - DNA, 22 bp, Homo sapiens
acagcaagtgtagacaggcaga

SEQ ID NO: 29492 - DNA, 23 bp, Homo sapiens
acagcaagtgtagacaggcagac

SEQ ID NO: 29493 - DNA, 19 bp, Homo sapiens
tgcctgtctacacttgctg

SEQ ID NO: 29494 - DNA, 28 bp, Homo sapiens
acagtagtctgcacattggttagactgg

SEQ ID NO: 29495 - DNA, 27 bp, Homo sapiens
acagtagtctgcacattggttagactg

SEQ ID NO: 29496 - DNA, 26 bp, Homo sapiens
acagtagtctgcacattggttagact

SEQ ID NO: 29497 - DNA, 25 bp, Homo sapiens
acagtagtctgcacattggttagac

SEQ ID NO: 29498 - DNA, 26 bp, Homo sapiens
tacagtagtctgcacattggttagac

SEQ ID NO: 29499 - DNA, 23 bp, Homo sapiens
cagtagtctgcacattggttaga

SEQ ID NO: 29500 - DNA, 24 bp, Homo sapiens
acagtagtctgcacattggttaga

SEQ ID NO: 29501 - DNA, 25 bp, Homo sapiens
tacagtagtctgcacattggttaga

SEQ ID NO: 29502 - DNA, 28 bp, Homo sapiens
cccagtgttcagactacctgttcaggac

SEQ ID NO: 29503 - DNA, 25 bp, Homo sapiens
ccccagtgttcagactacctgttca

SEQ ID NO: 29504 - DNA, 24 bp, Homo sapiens
ccccagtgttcagactacctgttc

SEQ ID NO: 29505 - DNA, 22 bp, Homo sapiens
cccagtgttcagactacctgtt

SEQ ID NO: 29506 - DNA, 23 bp, Homo sapiens
ccccagtgttcagactacctgtt

SEQ ID NO: 29507 - DNA, 24 bp, Homo sapiens
gccccagtgttcagactacctgtt

SEQ ID NO: 29508 - DNA, 21 bp, Homo sapiens
cccagtgttcagactacctgt

SEQ ID NO: 29509 - DNA, 22 bp, Homo sapiens
ccccagtgttcagactacctgt

SEQ ID NO: 29510 - DNA, 23 bp, Homo sapiens
gccccagtgttcagactacctgt

SEQ ID NO: 29511 - DNA, 24 bp, Homo sapiens
cgccccagtgttcagactacctgt

SEQ ID NO: 29512 - DNA, 21 bp, Homo sapiens
ccccagtgttcagactacctg

SEQ ID NO: 29513 - DNA, 20 bp, Homo sapiens
ccccagtgttcagactacct

SEQ ID NO: 29514 - DNA, 18 bp, Homo sapiens
ccccagtgttcagactac

SEQ ID NO: 29515 - DNA, 17 bp, Homo sapiens
ccccagtgttcagacta

SEQ ID NO: 29516 - DNA, 26 bp, Homo sapiens
tggagacgcggccctgttggagtaac

SEQ ID NO: 29517 - DNA, 22 bp, Homo sapiens
agacgcggccctgttggagtaa

SEQ ID NO: 29518 - DNA, 25 bp, Homo sapiens
tggagacgcggccctgttggagtaa

SEQ ID NO: 29519 - DNA, 21 bp, Homo sapiens
agacgcggccctgttggagta

SEQ ID NO: 29520 - DNA, 24 bp, Homo sapiens
tggagacgcggccctgttggagta

SEQ ID NO: 29521 - DNA, 16 bp, Homo sapiens
gcggccctgttggagt

SEQ ID NO: 29522 - DNA, 18 bp, Homo sapiens
acgcggccctgttggagt

SEQ ID NO: 29523 - DNA, 20 bp, Homo sapiens
agacgcggccctgttggagt

SEQ ID NO: 29524 - DNA, 22 bp, Homo sapiens
ggagacgcggccctgttggagt

SEQ ID NO: 29525 - DNA, 22 bp, Homo sapiens
tggagacgcggccctgttggag

SEQ ID NO: 29526 - DNA, 17 bp, Homo sapiens
gacgcggccctgttgga

SEQ ID NO: 29527 - DNA, 21 bp, Homo sapiens
tggagacgcggccctgttgga

SEQ ID NO: 29528 - DNA, 20 bp, Homo sapiens
tggagacgcggccctgttgg

SEQ ID NO: 29529 - DNA, 19 bp, Homo sapiens
tggagacgcggccctgttg

SEQ ID NO: 29530 - DNA, 16 bp, Homo sapiens
tggagacgcggccctg

SEQ ID NO: 29531 - DNA, 27 bp, Homo sapiens
tctacagtgcacgtgtctccagtgtgg

SEQ ID NO: 29532 - DNA, 25 bp, Homo sapiens
tctacagtgcacgtgtctccagtgt

SEQ ID NO: 29533 - DNA, 23 bp, Homo sapiens
ctacagtgcacgtgtctccagtg

SEQ ID NO: 29534 - DNA, 24 bp, Homo sapiens
tctacagtgcacgtgtctccagtg

SEQ ID NO: 29535 - DNA, 22 bp, Homo sapiens
tctacagtgcacgtgtctccag

SEQ ID NO: 29536 - DNA, 21 bp, Homo sapiens
tctacagtgcacgtgtctcca

SEQ ID NO: 29537 - DNA, 20 bp, Homo sapiens
tctacagtgcacgtgtctcc

SEQ ID NO: 29538 - DNA, 19 bp, Homo sapiens
tctacagtgcacgtgtctc

SEQ ID NO: 29539 - DNA, 21 bp, Homo sapiens
tcaggcagtgtgggtatcaga

SEQ ID NO: 29540 - DNA, 20 bp, Homo sapiens
taagtgcttccatgcttcag

SEQ ID NO: 29541 - DNA, 23 bp, Homo sapiens
taagtgcttccatgcttcagttt

SEQ ID NO: 29542 - DNA, 22 bp, Homo sapiens
aagtgcttccatgcttcagttt

SEQ ID NO: 29543 - DNA, 17 bp, Homo sapiens
ggcaaaaacggcaatga

SEQ ID NO: 29544 - DNA, 20 bp, Homo sapiens
aaacggcaatgacttttgta

SEQ ID NO: 29545 - DNA, 21 bp, Homo sapiens
aaacggcaatgacttttgtac

SEQ ID NO: 29546 - DNA, 22 bp, Homo sapiens
aaacggcaatgacttttgtacc

SEQ ID NO: 29547 - DNA, 23 bp, Homo sapiens
aaacggcaatgacttttgtacca

SEQ ID NO: 29548 - DNA, 26 bp, Homo sapiens
aaacggcaatgacttttgtaccaatc

SEQ ID NO: 29549 - DNA, 20 bp, Homo sapiens
aacggcaatgacttttgtac

SEQ ID NO: 29550 - DNA, 21 bp, Homo sapiens
aacggcaatgacttttgtacc

SEQ ID NO: 29551 - DNA, 23 bp, Homo sapiens
aacggcaatgacttttgtaccaa

SEQ ID NO: 29552 - DNA, 24 bp, Homo sapiens
aacggcaatgacttttgtaccaat

SEQ ID NO: 29553 - DNA, 25 bp, Homo sapiens
aacggcaatgacttttgtaccaatc

SEQ ID NO: 29554 - DNA, 20 bp, Homo sapiens
acggcaatgacttttgtacc

SEQ ID NO: 29555 - DNA, 21 bp, Homo sapiens
acggcaatgacttttgtacca

SEQ ID NO: 29556 - DNA, 22 bp, Homo sapiens
acggcaatgacttttgtaccaa

SEQ ID NO: 29557 - DNA, 24 bp, Homo sapiens
acggcaatgacttttgtaccaatc

SEQ ID NO: 29558 - DNA, 22 bp, Homo sapiens
cggcaatgacttttgtaccaat

SEQ ID NO: 29559 - DNA, 23 bp, Homo sapiens
gacggatactgtcatctattcca

SEQ ID NO: 29560 - DNA, 21 bp, Homo sapiens
actgcaagacggatactgtca

SEQ ID NO: 29561 - DNA, 20 bp, Homo sapiens
actgcaagacggatactgtc

SEQ ID NO: 29562 - DNA, 24 bp, Homo sapiens
agccactgcaagacggatactgtc

SEQ ID NO: 29563 - DNA, 23 bp, Homo sapiens
agccactgcaagacggatactgt

SEQ ID NO: 29564 - DNA, 22 bp, Homo sapiens
agccactgcaagacggatactg

SEQ ID NO: 29565 - DNA, 21 bp, Homo sapiens
agccactgcaagacggatact

SEQ ID NO: 29566 - DNA, 17 bp, Homo sapiens
agccactgcaagacgga

SEQ ID NO: 29567 - DNA, 23 bp, Homo sapiens
cctctgggcccttcctccagccc

SEQ ID NO: 29568 - DNA, 22 bp, Homo sapiens
cctctgggcccttcctccagcc

SEQ ID NO: 29569 - DNA, 21 bp, Homo sapiens
cctctgggcccttcctccagc

SEQ ID NO: 29570 - DNA, 19 bp, Homo sapiens
cctctgggcccttcctcca

SEQ ID NO: 29571 - DNA, 22 bp, Homo sapiens
ggacctgccagccccgttccag

SEQ ID NO: 29572 - DNA, 25 bp, Homo sapiens
cctgccagccccgttccagggcaca

SEQ ID NO: 29573 - DNA, 26 bp, Homo sapiens
cctgccagccccgttccagggcacag

SEQ ID NO: 29574 - DNA, 24 bp, Homo sapiens
ttgaaaggctatttcttggtcaga

SEQ ID NO: 29575 - DNA, 23 bp, Homo sapiens
ttgaaaggctatttcttggtcag

SEQ ID NO: 29576 - DNA, 24 bp, Homo sapiens
tttgaaaggctatttcttggtcag

SEQ ID NO: 29577 - DNA, 21 bp, Homo sapiens
tgaaaggctatttcttggtca

SEQ ID NO: 29578 - DNA, 22 bp, Homo sapiens
ttgaaaggctatttcttggtca

SEQ ID NO: 29579 - DNA, 23 bp, Homo sapiens
tttgaaaggctatttcttggtca

SEQ ID NO: 29580 - DNA, 16 bp, Homo sapiens
aggctatttcttggtc

SEQ ID NO: 29581 - DNA, 20 bp, Homo sapiens
tgaaaggctatttcttggtc

SEQ ID NO: 29582 - DNA, 27 bp, Homo sapiens
aattgtttgaaaggctatttcttggtc

SEQ ID NO: 29583 - DNA, 20 bp, Homo sapiens
ttgaaaggctatttcttggt

SEQ ID NO: 29584 - DNA, 19 bp, Homo sapiens
ttgaaaggctatttcttgg

SEQ ID NO: 29585 - DNA, 20 bp, Homo sapiens
tttgaaaggctatttcttgg

SEQ ID NO: 29586 - DNA, 18 bp, Homo sapiens
ttgaaaggctatttcttg

SEQ ID NO: 29587 - DNA, 17 bp, Homo sapiens
ttgaaaggctatttctt

SEQ ID NO: 29588 - DNA, 24 bp, Homo sapiens
cccagataatggcactctcaaaca

SEQ ID NO: 29589 - DNA, 22 bp, Homo sapiens
ccagataatggcactctcaaac

SEQ ID NO: 29590 - DNA, 23 bp, Homo sapiens
cccagataatggcactctcaaac

SEQ ID NO: 29591 - DNA, 22 bp, Homo sapiens
cccagataatggcactctcaaa

SEQ ID NO: 29592 - DNA, 20 bp, Homo sapiens
cccagataatggcactctca

SEQ ID NO: 29593 - DNA, 19 bp, Homo sapiens
cccagataatggcactctc

SEQ ID NO: 29594 - DNA, 20 bp, Homo sapiens
agagttaactcaaaatggac

SEQ ID NO: 29595 - DNA, 21 bp, Homo sapiens
agagttaactcaaaatggact

SEQ ID NO: 29596 - DNA, 20 bp, Homo sapiens
agttaactcaaaatggacta

SEQ ID NO: 29597 - DNA, 22 bp, Homo sapiens
agttaactcaaaatggactaat

SEQ ID NO: 29598 - DNA, 23 bp, Homo sapiens
aactagactgtgagcttctagag

SEQ ID NO: 29599 - DNA, 24 bp, Homo sapiens
caactagactgtgagcttctagag

SEQ ID NO: 29600 - DNA, 21 bp, Homo sapiens
actagactgtgagcttctaga

SEQ ID NO: 29601 - DNA, 22 bp, Homo sapiens
aactagactgtgagcttctaga

SEQ ID NO: 29602 - DNA, 23 bp, Homo sapiens
caactagactgtgagcttctaga

SEQ ID NO: 29603 - DNA, 21 bp, Homo sapiens
aactagactgtgagcttctag

SEQ ID NO: 29604 - DNA, 20 bp, Homo sapiens
aactagactgtgagcttcta

SEQ ID NO: 29605 - DNA, 21 bp, Homo sapiens
caactagactgtgagcttcta

SEQ ID NO: 29606 - DNA, 25 bp, Homo sapiens
aaggagcttacaatctagctggggg

SEQ ID NO: 29607 - DNA, 24 bp, Homo sapiens
aaggagcttacaatctagctgggg

SEQ ID NO: 29608 - DNA, 22 bp, Homo sapiens
aaggagcttacaatctagctgg

SEQ ID NO: 29609 - DNA, 21 bp, Homo sapiens
aaggagcttacaatctagctg

SEQ ID NO: 29610 - DNA, 20 bp, Homo sapiens
aaggagcttacaatctagct

SEQ ID NO: 29611 - DNA, 22 bp, Homo sapiens
tagcttaaggagtaccagatca

SEQ ID NO: 29612 - DNA, 23 bp, Homo sapiens
ttagcttaaggagtaccagatca

SEQ ID NO: 29613 - DNA, 21 bp, Homo sapiens
tagcttaaggagtaccagatc

SEQ ID NO: 29614 - DNA, 20 bp, Homo sapiens
tagcttaaggagtaccagat

SEQ ID NO: 29615 - DNA, 21 bp, Homo sapiens
ttagcttaaggagtaccagat

SEQ ID NO: 29616 - DNA, 18 bp, Homo sapiens
tagcttaaggagtaccag

SEQ ID NO: 29617 - DNA, 21 bp, Homo sapiens
cattagcttaaggagtaccag

SEQ ID NO: 29618 - DNA, 23 bp, Homo sapiens
tatggtactccttaagctaacag

SEQ ID NO: 29619 - DNA, 21 bp, Homo sapiens
atggtactccttaagctaaca

SEQ ID NO: 29620 - DNA, 22 bp, Homo sapiens
tatggtactccttaagctaaca

SEQ ID NO: 29621 - DNA, 20 bp, Homo sapiens
tatggtactccttaagctaa

SEQ ID NO: 29622 - DNA, 19 bp, Homo sapiens
tatggtactccttaagcta

SEQ ID NO: 29623 - DNA, 18 bp, Homo sapiens
tatggtactccttaagct

SEQ ID NO: 29624 - DNA, 22 bp, Homo sapiens
atagagtaggcaaaggacagaa

SEQ ID NO: 29625 - DNA, 23 bp, Homo sapiens
taaatagagtaggcaaaggacag

SEQ ID NO: 29626 - DNA, 21 bp, Homo sapiens
taaatagagtaggcaaaggac

SEQ ID NO: 29627 - DNA, 20 bp, Homo sapiens
taaatagagtaggcaaagga

SEQ ID NO: 29628 - DNA, 19 bp, Homo sapiens
taaatagagtaggcaaagg

SEQ ID NO: 29629 - DNA, 17 bp, Homo sapiens
taaatagagtaggcaaa

SEQ ID NO: 29630 - DNA, 23 bp, Homo sapiens
cctttgcctattctatttaagac

SEQ ID NO: 29631 - DNA, 23 bp, Homo sapiens
tcctttgcctattctatttaaga

SEQ ID NO: 29632 - DNA, 20 bp, Homo sapiens
tcctttgcctattctattta

SEQ ID NO: 29633 - DNA, 17 bp, Homo sapiens
tcctttgcctattctat

SEQ ID NO: 29634 - DNA, 24 bp, Homo sapiens
tgggagctggactacttctgaacc

SEQ ID NO: 29635 - DNA, 21 bp, Homo sapiens
ggagctggactacttctgaac

SEQ ID NO: 29636 - DNA, 23 bp, Homo sapiens
tgggagctggactacttctgaac

SEQ ID NO: 29637 - DNA, 22 bp, Homo sapiens
tgggagctggactacttctgaa

SEQ ID NO: 29638 - DNA, 21 bp, Homo sapiens
tgggagctggactacttctga

SEQ ID NO: 29639 - DNA, 20 bp, Homo sapiens
tgggagctggactacttctg

SEQ ID NO: 29640 - DNA, 19 bp, Homo sapiens
tgggagctggactacttct

SEQ ID NO: 29641 - DNA, 17 bp, Homo sapiens
tgggagctggactactt

SEQ ID NO: 29642 - DNA, 22 bp, Homo sapiens
tttagggtagacactgacaacg

SEQ ID NO: 29643 - DNA, 19 bp, Homo sapiens
ttagggtagacactgacaa

SEQ ID NO: 29644 - DNA, 21 bp, Homo sapiens
ttagggtagacactgacaacg

SEQ ID NO: 29645 - DNA, 22 bp, Homo sapiens
ttagggtagacactgacaacgt

SEQ ID NO: 29646 - DNA, 23 bp, Homo sapiens
ttagggtagacactgacaacgtt

SEQ ID NO: 29647 - DNA, 26 bp, Homo sapiens
ttagggtagacactgacaacgttatg

SEQ ID NO: 29648 - DNA, 20 bp, Homo sapiens
tagggtagacactgacaacg

SEQ ID NO: 29649 - DNA, 21 bp, Homo sapiens
tagggtagacactgacaacgt

SEQ ID NO: 29650 - DNA, 23 bp, Homo sapiens
tagggtagacactgacaacgtta

SEQ ID NO: 29651 - DNA, 20 bp, Homo sapiens
agggtagacactgacaacgt

SEQ ID NO: 29652 - DNA, 20 bp, Homo sapiens
gggtagacactgacaacgtt

SEQ ID NO: 29653 - DNA, 21 bp, Homo sapiens
ggtagacactgacaacgttat

SEQ ID NO: 29654 - DNA, 22 bp, Homo sapiens
ggtagacactgacaacgttatg

SEQ ID NO: 29655 - DNA, 24 bp, Homo sapiens
ctgttgtcatgttttttccctaga

SEQ ID NO: 29656 - DNA, 20 bp, Homo sapiens
tgttgtcatgttttttccct

SEQ ID NO: 29657 - DNA, 23 bp, Homo sapiens
tgttgtcatgttttttccctaga

SEQ ID NO: 29658 - DNA, 21 bp, Homo sapiens
gttgtcatgttttttccctag

SEQ ID NO: 29659 - DNA, 22 bp, Homo sapiens
gttgtcatgttttttccctaga

SEQ ID NO: 29660 - DNA, 23 bp, Homo sapiens
ttgtcatgttttttccctagatg

SEQ ID NO: 29661 - DNA, 24 bp, Homo sapiens
cgcagacaatgcctactggcctaa

SEQ ID NO: 29662 - DNA, 25 bp, Homo sapiens
cgcagacaatgcctactggcctaag

SEQ ID NO: 29663 - DNA, 22 bp, Homo sapiens
gcagacaatgcctactggccta

SEQ ID NO: 29664 - DNA, 21 bp, Homo sapiens
cagacaatgcctactggccta

SEQ ID NO: 29665 - DNA, 22 bp, Homo sapiens
cagacaatgcctactggcctaa

SEQ ID NO: 29666 - DNA, 21 bp, Homo sapiens
agacaatgcctactggcctaa

SEQ ID NO: 29667 - DNA, 22 bp, Homo sapiens
agacaatgcctactggcctaag

SEQ ID NO: 29668 - DNA, 22 bp, Homo sapiens
tggtaagagatttgggcatatt

SEQ ID NO: 29669 - DNA, 24 bp, Homo sapiens
tctggtaagagatttgggcatatt

SEQ ID NO: 29670 - DNA, 23 bp, Homo sapiens
tctggtaagagatttgggcatat

SEQ ID NO: 29671 - DNA, 21 bp, Homo sapiens
atggataaggctttggcttat

SEQ ID NO: 29672 - DNA, 21 bp, Homo sapiens
gagctccgagaaagctgacag

SEQ ID NO: 29673 - DNA, 23 bp, Homo sapiens
ttgctctgagctccgagaaagct

SEQ ID NO: 29674 - DNA, 24 bp, Homo sapiens
tgatctcaccgctgcctccttccc

SEQ ID NO: 29675 - DNA, 25 bp, Homo sapiens
ctgatctcaccgctgcctccttccc

SEQ ID NO: 29676 - DNA, 23 bp, Homo sapiens
tgatctcaccgctgcctccttcc

SEQ ID NO: 29677 - DNA, 24 bp, Homo sapiens
ctgatctcaccgctgcctccttcc

SEQ ID NO: 29678 - DNA, 21 bp, Homo sapiens
gatctcaccgctgcctccttc

SEQ ID NO: 29679 - DNA, 23 bp, Homo sapiens
ctgatctcaccgctgcctccttc

SEQ ID NO: 29680 - DNA, 21 bp, Homo sapiens
tgatctcaccgctgcctcctt

SEQ ID NO: 29681 - DNA, 21 bp, Homo sapiens
ctgatctcaccgctgcctcct

SEQ ID NO: 29682 - DNA, 18 bp, Homo sapiens
gatctcaccgctgcctcc

SEQ ID NO: 29683 - DNA, 19 bp, Homo sapiens
tgatctcaccgctgcctcc

SEQ ID NO: 29684 - DNA, 16 bp, Homo sapiens
tgatctcaccgctgcc

SEQ ID NO: 29685 - DNA, 24 bp, Homo sapiens
caggaggcagtgggcgagcaggcg

SEQ ID NO: 29686 - DNA, 23 bp, Homo sapiens
caggaggcagtgggcgagcaggc

SEQ ID NO: 29687 - DNA, 20 bp, Homo sapiens
aggaggcagtgggcgagcag

SEQ ID NO: 29688 - DNA, 21 bp, Homo sapiens
caggaggcagtgggcgagcag

SEQ ID NO: 29689 - DNA, 20 bp, Homo sapiens
caggaggcagtgggcgagca

SEQ ID NO: 29690 - DNA, 19 bp, Homo sapiens
caggaggcagtgggcgagc

SEQ ID NO: 29691 - DNA, 24 bp, Homo sapiens
tacctgcaggaggcagtgggcgag

SEQ ID NO: 29692 - DNA, 19 bp, Homo sapiens
gtagtactgtgcatatcat

SEQ ID NO: 29693 - DNA, 20 bp, Homo sapiens
gtagtactgtgcatatcatc

SEQ ID NO: 29694 - DNA, 21 bp, Homo sapiens
gtagtactgtgcatatcatct

SEQ ID NO: 29695 - DNA, 22 bp, Homo sapiens
gtagtactgtgcatatcatcta

SEQ ID NO: 29696 - DNA, 23 bp, Homo sapiens
gtagtactgtgcatatcatctat

SEQ ID NO: 29697 - DNA, 24 bp, Homo sapiens
gtagtactgtgcatatcatctatg

SEQ ID NO: 29698 - DNA, 20 bp, Homo sapiens
tagtactgtgcatatcatct

SEQ ID NO: 29699 - DNA, 21 bp, Homo sapiens
tagtactgtgcatatcatcta

SEQ ID NO: 29700 - DNA, 23 bp, Homo sapiens
tagtactgtgcatatcatctatg

SEQ ID NO: 29701 - DNA, 20 bp, Homo sapiens
tactgtgcatatcatctatg

SEQ ID NO: 29702 - DNA, 25 bp, Homo sapiens
tctcactgtagcctcgaacccctgg

SEQ ID NO: 29703 - DNA, 24 bp, Homo sapiens
tctcactgtagcctcgaacccctg

SEQ ID NO: 29704 - DNA, 23 bp, Homo sapiens
tctcactgtagcctcgaacccct

SEQ ID NO: 29705 - DNA, 23 bp, Homo sapiens
atctcactgtagcctcgaacccc

SEQ ID NO: 29706 - DNA, 21 bp, Homo sapiens
tctcactgtagcctcgaaccc

SEQ ID NO: 29707 - DNA, 23 bp, Homo sapiens
catctcactgtagcctcgaaccc

SEQ ID NO: 29708 - DNA, 20 bp, Homo sapiens
tctcactgtagcctcgaacc

SEQ ID NO: 29709 - DNA, 22 bp, Homo sapiens
catctcactgtagcctcgaacc

SEQ ID NO: 29710 - DNA, 27 bp, Homo sapiens
ggtttgaggctacagtgagatgtgatc

SEQ ID NO: 29711 - DNA, 25 bp, Homo sapiens
cggtttgaggctacagtgagatgtg

SEQ ID NO: 29712 - DNA, 24 bp, Homo sapiens
cggtttgaggctacagtgagatgt

SEQ ID NO: 29713 - DNA, 23 bp, Homo sapiens
cggtttgaggctacagtgagatg

SEQ ID NO: 29714 - DNA, 22 bp, Homo sapiens
cggtttgaggctacagtgagat

SEQ ID NO: 29715 - DNA, 21 bp, Homo sapiens
cggtttgaggctacagtgaga

SEQ ID NO: 29716 - DNA, 20 bp, Homo sapiens
cggtttgaggctacagtgag

SEQ ID NO: 29717 - DNA, 23 bp, Homo sapiens
aaaagtatttgcgggttttgtcg

SEQ ID NO: 29718 - DNA, 21 bp, Homo sapiens
aaaagtatttgcgggttttgt

SEQ ID NO: 29719 - DNA, 20 bp, Homo sapiens
aaaagtatttgcgggttttg

SEQ ID NO: 29720 - DNA, 19 bp, Homo sapiens
aaaagtatttgcgggtttt

SEQ ID NO: 29721 - DNA, 18 bp, Homo sapiens
aaaagtatttgcgggttt

SEQ ID NO: 29722 - DNA, 20 bp, Homo sapiens
tatcccaccactgccaccat

SEQ ID NO: 29723 - DNA, 21 bp, Homo sapiens
tatcccaccactgccaccatt

SEQ ID NO: 29724 - DNA, 20 bp, Homo sapiens
atcccaccactgccaccatt

SEQ ID NO: 29725 - DNA, 21 bp, Homo sapiens
atcccaccactgccaccatta

SEQ ID NO: 29726 - DNA, 22 bp, Homo sapiens
atcccaccactgccaccattat

SEQ ID NO: 29727 - DNA, 23 bp, Homo sapiens
atcccaccactgccaccattatt

SEQ ID NO: 29728 - DNA, 25 bp, Homo sapiens
atcccaccactgccaccattattgc

SEQ ID NO: 29729 - DNA, 20 bp, Homo sapiens
tcccaccactgccaccatta

SEQ ID NO: 29730 - DNA, 21 bp, Homo sapiens
tcccaccactgccaccattat

SEQ ID NO: 29731 - DNA, 22 bp, Homo sapiens
tcccaccactgccaccattatt

SEQ ID NO: 29732 - DNA, 22 bp, Homo sapiens
aaaggtgctcaaattagacatt

SEQ ID NO: 29733 - DNA, 23 bp, Homo sapiens
caaaggtgctcaaattagacatt

SEQ ID NO: 29734 - DNA, 18 bp, Homo sapiens
aaaggtgctcaaattaga

SEQ ID NO: 29735 - DNA, 25 bp, Homo sapiens
cctaatttgaacaccttcggtattc

SEQ ID NO: 29736 - DNA, 24 bp, Homo sapiens
cctaatttgaacaccttcggtatt

SEQ ID NO: 29737 - DNA, 23 bp, Homo sapiens
cctaatttgaacaccttcggtat

SEQ ID NO: 29738 - DNA, 21 bp, Homo sapiens
cctaatttgaacaccttcggt

SEQ ID NO: 29739 - DNA, 19 bp, Homo sapiens
cctaatttgaacaccttcg

SEQ ID NO: 29740 - DNA, 21 bp, Homo sapiens
tgcctaatttgaacaccttcg

SEQ ID NO: 29741 - DNA, 23 bp, Homo sapiens
ctcactgaacaatgaatgcaact

SEQ ID NO: 29742 - DNA, 21 bp, Homo sapiens
tcactgaacaatgaatgcaac

SEQ ID NO: 29743 - DNA, 22 bp, Homo sapiens
ctcactgaacaatgaatgcaac

SEQ ID NO: 29744 - DNA, 23 bp, Homo sapiens
gctcactgaacaatgaatgcaac

SEQ ID NO: 29745 - DNA, 24 bp, Homo sapiens
agctcactgaacaatgaatgcaac

SEQ ID NO: 29746 - DNA, 27 bp, Homo sapiens
gacaagctcactgaacaatgaatgcaa

SEQ ID NO: 29747 - DNA, 20 bp, Homo sapiens
ctcactgaacaatgaatgca

SEQ ID NO: 29748 - DNA, 22 bp, Homo sapiens
agctcactgaacaatgaatgca

SEQ ID NO: 29749 - DNA, 19 bp, Homo sapiens
ctcactgaacaatgaatgc

SEQ ID NO: 29750 - DNA, 23 bp, Homo sapiens
caagctcactgaacaatgaatgc

SEQ ID NO: 29751 - DNA, 17 bp, Homo sapiens
gacaagctcactgaaca

SEQ ID NO: 29752 - DNA, 16 bp, Homo sapiens
gacaagctcactgaac

SEQ ID NO: 29753 - DNA, 21 bp, Homo sapiens
ttgctgtcggtgggttgaact

SEQ ID NO: 29754 - DNA, 20 bp, Homo sapiens
ttgctgtcggtgggttgaac

SEQ ID NO: 29755 - DNA, 21 bp, Homo sapiens
attgctgtcggtgggttgaac

SEQ ID NO: 29756 - DNA, 26 bp, Homo sapiens
cattcattgctgtcggtgggttgaac

SEQ ID NO: 29757 - DNA, 27 bp, Homo sapiens
acattcattgctgtcggtgggttgaac

SEQ ID NO: 29758 - DNA, 28 bp, Homo sapiens
aacattcattgctgtcggtgggttgaac

SEQ ID NO: 29759 - DNA, 27 bp, Homo sapiens
aacattcattgctgtcggtgggttgaa

SEQ ID NO: 29760 - DNA, 25 bp, Homo sapiens
acattcattgctgtcggtgggttga

SEQ ID NO: 29761 - DNA, 26 bp, Homo sapiens
aacattcattgctgtcggtgggttga

SEQ ID NO: 29762 - DNA, 24 bp, Homo sapiens
acattcattgctgtcggtgggttg

SEQ ID NO: 29763 - DNA, 25 bp, Homo sapiens
aacattcattgctgtcggtgggttg

SEQ ID NO: 29764 - DNA, 24 bp, Homo sapiens
aacattcattgctgtcggtgggtt

SEQ ID NO: 29765 - DNA, 25 bp, Homo sapiens
accatcgaccgttgattgtacccta

SEQ ID NO: 29766 - DNA, 24 bp, Homo sapiens
accatcgaccgttgattgtaccct

SEQ ID NO: 29767 - DNA, 23 bp, Homo sapiens
accatcgaccgttgattgtaccc

SEQ ID NO: 29768 - DNA, 21 bp, Homo sapiens
accatcgaccgttgattgtac

SEQ ID NO: 29769 - DNA, 20 bp, Homo sapiens
accatcgaccgttgattgta

SEQ ID NO: 29770 - DNA, 19 bp, Homo sapiens
accatcgaccgttgattgt

SEQ ID NO: 29771 - DNA, 18 bp, Homo sapiens
accatcgaccgttgattg

SEQ ID NO: 29772 - DNA, 17 bp, Homo sapiens
accatcgaccgttgatt

SEQ ID NO: 29773 - DNA, 16 bp, Homo sapiens
accatcgaccgttgat

SEQ ID NO: 29774 - DNA, 21 bp, Homo sapiens
acgctgtcggtgagtttggaa

SEQ ID NO: 29775 - DNA, 25 bp, Homo sapiens
ttcaacgctgtcggtgagtttggaa

SEQ ID NO: 29776 - DNA, 20 bp, Homo sapiens
acgctgtcggtgagtttgga

SEQ ID NO: 29777 - DNA, 25 bp, Homo sapiens
attcaacgctgtcggtgagtttgga

SEQ ID NO: 29778 - DNA, 27 bp, Homo sapiens
acattcaacgctgtcggtgagtttgga

SEQ ID NO: 29779 - DNA, 28 bp, Homo sapiens
aacattcaacgctgtcggtgagtttgga

SEQ ID NO: 29780 - DNA, 25 bp, Homo sapiens
aacattcaacgctgtcggtgagttt

SEQ ID NO: 29781 - DNA, 24 bp, Homo sapiens
aacattcaacgctgtcggtgagtt

SEQ ID NO: 29782 - DNA, 25 bp, Homo sapiens
tgaacattcaacgctgtcggtgagt

SEQ ID NO: 29783 - DNA, 22 bp, Homo sapiens
aacattcaacgctgtcggtgag

SEQ ID NO: 29784 - DNA, 24 bp, Homo sapiens
tgaacattcaacgctgtcggtgag

SEQ ID NO: 29785 - DNA, 21 bp, Homo sapiens
aacattcaacgctgtcggtga

SEQ ID NO: 29786 - DNA, 24 bp, Homo sapiens
gtgaacattcaacgctgtcggtga

SEQ ID NO: 29787 - DNA, 22 bp, Homo sapiens
tgaacattcaacgctgtcggtg

SEQ ID NO: 29788 - DNA, 16 bp, Homo sapiens
aacattcaacgctgtc

SEQ ID NO: 29789 - DNA, 22 bp, Homo sapiens
agagaggataggaagaatgaag

SEQ ID NO: 29790 - DNA, 25 bp, Homo sapiens
agagaggataggaagaatgaagtgc

SEQ ID NO: 29791 - DNA, 28 bp, Homo sapiens
agagaggataggaagaatgaagtgctgg

SEQ ID NO: 29792 - DNA, 23 bp, Homo sapiens
agaggataggaagaatgaagtgc

SEQ ID NO: 29793 - DNA, 21 bp, Homo sapiens
gaggataggaagaatgaagtg

SEQ ID NO: 29794 - DNA, 22 bp, Homo sapiens
gaggataggaagaatgaagtgc

SEQ ID NO: 29795 - DNA, 23 bp, Homo sapiens
aggataggaagaatgaagtgctg

SEQ ID NO: 29796 - DNA, 22 bp, Homo sapiens
gataggaagaatgaagtgctgg

SEQ ID NO: 29797 - DNA, 22 bp, Homo sapiens
ggaagaatgaagtgctgggcgc

SEQ ID NO: 29798 - DNA, 17 bp, Homo sapiens
aggtcagtgtctgggcg

SEQ ID NO: 29799 - DNA, 21 bp, Homo sapiens
agtgtctgggcggacagctgc

SEQ ID NO: 29800 - DNA, 22 bp, Homo sapiens
gtgtctgggcggacagctgcag

SEQ ID NO: 29801 - DNA, 23 bp, Homo sapiens
gtgtctgggcggacagctgcagg

SEQ ID NO: 29802 - DNA, 25 bp, Homo sapiens
gtgtctgggcggacagctgcaggaa

SEQ ID NO: 29803 - DNA, 26 bp, Homo sapiens
gtgtctgggcggacagctgcaggaaa

SEQ ID NO: 29804 - DNA, 17 bp, Homo sapiens
tgtctgggcggacagct

SEQ ID NO: 29805 - DNA, 26 bp, Homo sapiens
aatgtgggaaagagaaagaacaagta

SEQ ID NO: 29806 - DNA, 20 bp, Homo sapiens
atgtgggaaagagaaagaac

SEQ ID NO: 29807 - DNA, 21 bp, Homo sapiens
atgtgggaaagagaaagaaca

SEQ ID NO: 29808 - DNA, 22 bp, Homo sapiens
atgtgggaaagagaaagaacaa

SEQ ID NO: 29809 - DNA, 23 bp, Homo sapiens
tgtgggaaagagaaagaacaagt

SEQ ID NO: 29810 - DNA, 22 bp, Homo sapiens
gtgggaaagagaaagaacaagt

SEQ ID NO: 29811 - DNA, 19 bp, Homo sapiens
tgggaaagagaaagaacaa

SEQ ID NO: 29812 - DNA, 21 bp, Homo sapiens
tgggaaagagaaagaacaagt

SEQ ID NO: 29813 - DNA, 23 bp, Homo sapiens
tgggaaagagaaagaacaagtaa

SEQ ID NO: 29814 - DNA, 22 bp, Homo sapiens
cccctaattgttctgtctttct

SEQ ID NO: 29815 - DNA, 25 bp, Homo sapiens
ctaattgttctgtctttctcccagt

SEQ ID NO: 29816 - DNA, 23 bp, Homo sapiens
taattgttctgtctttctcccag

SEQ ID NO: 29817 - DNA, 24 bp, Homo sapiens
taattgttctgtctttctcccagt

SEQ ID NO: 29818 - DNA, 25 bp, Homo sapiens
taattgttctgtctttctcccagtg

SEQ ID NO: 29819 - DNA, 23 bp, Homo sapiens
aattgttctgtctttctcccagt

SEQ ID NO: 29820 - DNA, 26 bp, Homo sapiens
aattgttctgtctttctcccagtgtc

SEQ ID NO: 29821 - DNA, 20 bp, Homo sapiens
attgttctgtctttctccca

SEQ ID NO: 29822 - DNA, 22 bp, Homo sapiens
attgttctgtctttctcccagt

SEQ ID NO: 29823 - DNA, 23 bp, Homo sapiens
attgttctgtctttctcccagtg

SEQ ID NO: 29824 - DNA, 24 bp, Homo sapiens
attgttctgtctttctcccagtgt

SEQ ID NO: 29825 - DNA, 25 bp, Homo sapiens
attgttctgtctttctcccagtgtc

SEQ ID NO: 29826 - DNA, 24 bp, Homo sapiens
gagtttgggatggagagaggagaa

SEQ ID NO: 29827 - DNA, 19 bp, Homo sapiens
agtttgggatggagagagg

SEQ ID NO: 29828 - DNA, 20 bp, Homo sapiens
agtttgggatggagagagga

SEQ ID NO: 29829 - DNA, 21 bp, Homo sapiens
agtttgggatggagagaggag

SEQ ID NO: 29830 - DNA, 23 bp, Homo sapiens
agtttgggatggagagaggagaa

SEQ ID NO: 29831 - DNA, 24 bp, Homo sapiens
agtttgggatggagagaggagaaa

SEQ ID NO: 29832 - DNA, 25 bp, Homo sapiens
agtttgggatggagagaggagaaac

SEQ ID NO: 29833 - DNA, 22 bp, Homo sapiens
tttgggatggagagaggagaaa

SEQ ID NO: 29834 - DNA, 23 bp, Homo sapiens
tttgggatggagagaggagaaac

SEQ ID NO: 29835 - DNA, 21 bp, Homo sapiens
ttgggatggagagaggagaaa

SEQ ID NO: 29836 - DNA, 25 bp, Homo sapiens
tgatagtgtcttctctcctcccaaa

SEQ ID NO: 29837 - DNA, 19 bp, Homo sapiens
tgtcttctctcctcccaaa

SEQ ID NO: 29838 - DNA, 20 bp, Homo sapiens
tgtcttctctcctcccaaac

SEQ ID NO: 29839 - DNA, 21 bp, Homo sapiens
tgtcttctctcctcccaaaca

SEQ ID NO: 29840 - DNA, 23 bp, Homo sapiens
tgtcttctctcctcccaaacagg

SEQ ID NO: 29841 - DNA, 24 bp, Homo sapiens
tgtcttctctcctcccaaacaggt

SEQ ID NO: 29842 - DNA, 25 bp, Homo sapiens
tgtcttctctcctcccaaacaggtt

SEQ ID NO: 29843 - DNA, 22 bp, Homo sapiens
gtcttctctcctcccaaacagg

SEQ ID NO: 29844 - DNA, 24 bp, Homo sapiens
tgtagggctaaaagccatgggcta

SEQ ID NO: 29845 - DNA, 25 bp, Homo sapiens
atgtagggctaaaagccatgggcta

SEQ ID NO: 29846 - DNA, 19 bp, Homo sapiens
gggctaaaagccatgggct

SEQ ID NO: 29847 - DNA, 23 bp, Homo sapiens
tgtagggctaaaagccatgggct

SEQ ID NO: 29848 - DNA, 24 bp, Homo sapiens
atgtagggctaaaagccatgggct

SEQ ID NO: 29849 - DNA, 22 bp, Homo sapiens
tgtagggctaaaagccatgggc

SEQ ID NO: 29850 - DNA, 23 bp, Homo sapiens
atgtagggctaaaagccatgggc

SEQ ID NO: 29851 - DNA, 20 bp, Homo sapiens
tgtagggctaaaagccatgg

SEQ ID NO: 29852 - DNA, 21 bp, Homo sapiens
atgtagggctaaaagccatgg

SEQ ID NO: 29853 - DNA, 20 bp, Homo sapiens
atgtagggctaaaagccatg

SEQ ID NO: 29854 - DNA, 18 bp, Homo sapiens
atgtagggctaaaagcca

SEQ ID NO: 29855 - DNA, 16 bp, Homo sapiens
atgtagggctaaaagc

SEQ ID NO: 29856 - DNA, 28 bp, Homo sapiens
tatggcttttcattcctatgtgattgct

SEQ ID NO: 29857 - DNA, 25 bp, Homo sapiens
tatggcttttcattcctatgtgatt

SEQ ID NO: 29858 - DNA, 24 bp, Homo sapiens
tatggcttttcattcctatgtgat

SEQ ID NO: 29859 - DNA, 18 bp, Homo sapiens
cttttcattcctatgtga

SEQ ID NO: 29860 - DNA, 22 bp, Homo sapiens
tatggcttttcattcctatgtg

SEQ ID NO: 29861 - DNA, 25 bp, Homo sapiens
gcctatggcttttcattcctatgtg

SEQ ID NO: 29862 - DNA, 21 bp, Homo sapiens
tatggcttttcattcctatgt

SEQ ID NO: 29863 - DNA, 20 bp, Homo sapiens
tatggcttttcattcctatg

SEQ ID NO: 29864 - DNA, 19 bp, Homo sapiens
tatggcttttcattcctat

SEQ ID NO: 29865 - DNA, 18 bp, Homo sapiens
tatggcttttcattccta

SEQ ID NO: 29866 - DNA, 21 bp, Homo sapiens
tggtgggtggggaggagaagt

SEQ ID NO: 29867 - DNA, 22 bp, Homo sapiens
tggtgggtggggaggagaagtg

SEQ ID NO: 29868 - DNA, 20 bp, Homo sapiens
ggtgggtggggaggagaagt

SEQ ID NO: 29869 - DNA, 21 bp, Homo sapiens
ggtgggtggggaggagaagtg

SEQ ID NO: 29870 - DNA, 22 bp, Homo sapiens
ggtgggtggggaggagaagtgc

SEQ ID NO: 29871 - DNA, 24 bp, Homo sapiens
ggtgggtggggaggagaagtgccg

SEQ ID NO: 29872 - DNA, 19 bp, Homo sapiens
ccctctctgtcccacccat

SEQ ID NO: 29873 - DNA, 20 bp, Homo sapiens
ccctctctgtcccacccata

SEQ ID NO: 29874 - DNA, 22 bp, Homo sapiens
ccctctctgtcccacccatagg

SEQ ID NO: 29875 - DNA, 23 bp, Homo sapiens
ccctctctgtcccacccataggg

SEQ ID NO: 29876 - DNA, 24 bp, Homo sapiens
ccctctctgtcccacccatagggc

SEQ ID NO: 29877 - DNA, 21 bp, Homo sapiens
cctctctgtcccacccatagg

SEQ ID NO: 29878 - DNA, 22 bp, Homo sapiens
cctctctgtcccacccataggg

SEQ ID NO: 29879 - DNA, 19 bp, Homo sapiens
ctctgtcccacccataggg

SEQ ID NO: 29880 - DNA, 22 bp, Homo sapiens
caccatttgaaatcggttatga

SEQ ID NO: 29881 - DNA, 21 bp, Homo sapiens
caccatttgaaatcggttatg

SEQ ID NO: 29882 - DNA, 20 bp, Homo sapiens
caccatttgaaatcggttat

SEQ ID NO: 29883 - DNA, 23 bp, Homo sapiens
tagcaccatttgaaatcggttat

SEQ ID NO: 29884 - DNA, 19 bp, Homo sapiens
caccatttgaaatcggtta

SEQ ID NO: 29885 - DNA, 21 bp, Homo sapiens
agcaccatttgaaatcggtta

SEQ ID NO: 29886 - DNA, 18 bp, Homo sapiens
caccatttgaaatcggtt

SEQ ID NO: 29887 - DNA, 21 bp, Homo sapiens
tagcaccatttgaaatcggtt

SEQ ID NO: 29888 - DNA, 17 bp, Homo sapiens
caccatttgaaatcggt

SEQ ID NO: 29889 - DNA, 20 bp, Homo sapiens
tagcaccatttgaaatcggt

SEQ ID NO: 29890 - DNA, 19 bp, Homo sapiens
tagcaccatttgaaatcgg

SEQ ID NO: 29891 - DNA, 26 bp, Homo sapiens
accgatttctcctggtgttcagagtc

SEQ ID NO: 29892 - DNA, 27 bp, Homo sapiens
gaccgatttctcctggtgttcagagtc

SEQ ID NO: 29893 - DNA, 28 bp, Homo sapiens
tgaccgatttctcctggtgttcagagtc

SEQ ID NO: 29894 - DNA, 26 bp, Homo sapiens
tgaccgatttctcctggtgttcagag

SEQ ID NO: 29895 - DNA, 23 bp, Homo sapiens
accgatttctcctggtgttcaga

SEQ ID NO: 29896 - DNA, 22 bp, Homo sapiens
accgatttctcctggtgttcag

SEQ ID NO: 29897 - DNA, 24 bp, Homo sapiens
tgaccgatttctcctggtgttcag

SEQ ID NO: 29898 - DNA, 21 bp, Homo sapiens
accgatttctcctggtgttca

SEQ ID NO: 29899 - DNA, 22 bp, Homo sapiens
gaccgatttctcctggtgttca

SEQ ID NO: 29900 - DNA, 23 bp, Homo sapiens
tgaccgatttctcctggtgttca

SEQ ID NO: 29901 - DNA, 20 bp, Homo sapiens
accgatttctcctggtgttc

SEQ ID NO: 29902 - DNA, 21 bp, Homo sapiens
gaccgatttctcctggtgttc

SEQ ID NO: 29903 - DNA, 20 bp, Homo sapiens
gaccgatttctcctggtgtt

SEQ ID NO: 29904 - DNA, 21 bp, Homo sapiens
tgaccgatttctcctggtgtt

SEQ ID NO: 29905 - DNA, 26 bp, Homo sapiens
caccatttgaaatcagtgttttagga

SEQ ID NO: 29906 - DNA, 25 bp, Homo sapiens
caccatttgaaatcagtgttttagg

SEQ ID NO: 29907 - DNA, 28 bp, Homo sapiens
tagcaccatttgaaatcagtgttttagg

SEQ ID NO: 29908 - DNA, 24 bp, Homo sapiens
caccatttgaaatcagtgttttag

SEQ ID NO: 29909 - DNA, 23 bp, Homo sapiens
caccatttgaaatcagtgtttta

SEQ ID NO: 29910 - DNA, 26 bp, Homo sapiens
tagcaccatttgaaatcagtgtttta

SEQ ID NO: 29911 - DNA, 27 bp, Homo sapiens
ctagcaccatttgaaatcagtgtttta

SEQ ID NO: 29912 - DNA, 22 bp, Homo sapiens
caccatttgaaatcagtgtttt

SEQ ID NO: 29913 - DNA, 25 bp, Homo sapiens
tagcaccatttgaaatcagtgtttt

SEQ ID NO: 29914 - DNA, 19 bp, Homo sapiens
ccatttgaaatcagtgttt

SEQ ID NO: 29915 - DNA, 21 bp, Homo sapiens
caccatttgaaatcagtgttt

SEQ ID NO: 29916 - DNA, 23 bp, Homo sapiens
agcaccatttgaaatcagtgttt

SEQ ID NO: 29917 - DNA, 24 bp, Homo sapiens
tagcaccatttgaaatcagtgttt

SEQ ID NO: 29918 - DNA, 26 bp, Homo sapiens
atctagcaccatttgaaatcagtgtt

SEQ ID NO: 29919 - DNA, 25 bp, Homo sapiens
tatctagcaccatttgaaatcagtg

SEQ ID NO: 29920 - DNA, 26 bp, Homo sapiens
ctggtttcacatggtggcttagattt

SEQ ID NO: 29921 - DNA, 24 bp, Homo sapiens
tggtttcacatggtggcttagatt

SEQ ID NO: 29922 - DNA, 25 bp, Homo sapiens
ctggtttcacatggtggcttagatt

SEQ ID NO: 29923 - DNA, 26 bp, Homo sapiens
gctggtttcacatggtggcttagatt

SEQ ID NO: 29924 - DNA, 24 bp, Homo sapiens
ctggtttcacatggtggcttagat

SEQ ID NO: 29925 - DNA, 22 bp, Homo sapiens
tggtttcacatggtggcttaga

SEQ ID NO: 29926 - DNA, 23 bp, Homo sapiens
ctggtttcacatggtggcttaga

SEQ ID NO: 29927 - DNA, 24 bp, Homo sapiens
gctggtttcacatggtggcttaga

SEQ ID NO: 29928 - DNA, 23 bp, Homo sapiens
gctggtttcacatggtggcttag

SEQ ID NO: 29929 - DNA, 21 bp, Homo sapiens
ctggtttcacatggtggctta

SEQ ID NO: 29930 - DNA, 21 bp, Homo sapiens
gctggtttcacatggtggctt

SEQ ID NO: 29931 - DNA, 20 bp, Homo sapiens
gctggtttcacatggtggct

SEQ ID NO: 29932 - DNA, 22 bp, Homo sapiens
cttcttccgccagtcggtggcc

SEQ ID NO: 29933 - DNA, 27 bp, Homo sapiens
cttcttccgccagtcggtggccgggct

SEQ ID NO: 29934 - DNA, 17 bp, Homo sapiens
tcttccgccagtcggtg

SEQ ID NO: 29935 - DNA, 20 bp, Homo sapiens
cgccagtcggtggccgggct

SEQ ID NO: 29936 - DNA, 19 bp, Homo sapiens
agtcggtggccgggctggc

SEQ ID NO: 29937 - DNA, 17 bp, Homo sapiens
tccttcattccaccgga

SEQ ID NO: 29938 - DNA, 18 bp, Homo sapiens
tccttcattccaccggag

SEQ ID NO: 29939 - DNA, 19 bp, Homo sapiens
tccttcattccaccggagt

SEQ ID NO: 29940 - DNA, 21 bp, Homo sapiens
tccttcattccaccggagtct

SEQ ID NO: 29941 - DNA, 23 bp, Homo sapiens
tccttcattccaccggagtctgt

SEQ ID NO: 29942 - DNA, 24 bp, Homo sapiens
tccttcattccaccggagtctgtc

SEQ ID NO: 29943 - DNA, 26 bp, Homo sapiens
tccttcattccaccggagtctgtctc

SEQ ID NO: 29944 - DNA, 27 bp, Homo sapiens
tccttcattccaccggagtctgtctca

SEQ ID NO: 29945 - DNA, 21 bp, Homo sapiens
ccttcattccaccggagtctg

SEQ ID NO: 29946 - DNA, 20 bp, Homo sapiens
cttcattccaccggagtctg

SEQ ID NO: 29947 - DNA, 24 bp, Homo sapiens
cttcattccaccggagtctgtctc

SEQ ID NO: 29948 - DNA, 17 bp, Homo sapiens
cattccaccggagtctg

SEQ ID NO: 29949 - DNA, 16 bp, Homo sapiens
attccaccggagtctg

SEQ ID NO: 29950 - DNA, 23 bp, Homo sapiens
aaccagatttcagtggagtgaag

SEQ ID NO: 29951 - DNA, 25 bp, Homo sapiens
accagatttcagtggagtgaagttc

SEQ ID NO: 29952 - DNA, 24 bp, Homo sapiens
ccagatttcagtggagtgaagttc

SEQ ID NO: 29953 - DNA, 22 bp, Homo sapiens
cagatttcagtggagtgaagtt

SEQ ID NO: 29954 - DNA, 18 bp, Homo sapiens
gatttcagtggagtgaag

SEQ ID NO: 29955 - DNA, 19 bp, Homo sapiens
gatttcagtggagtgaagt

SEQ ID NO: 29956 - DNA, 20 bp, Homo sapiens
gatttcagtggagtgaagtt

SEQ ID NO: 29957 - DNA, 22 bp, Homo sapiens
gatttcagtggagtgaagttca

SEQ ID NO: 29958 - DNA, 23 bp, Homo sapiens
gatttcagtggagtgaagttcag

SEQ ID NO: 29959 - DNA, 20 bp, Homo sapiens
atttcagtggagtgaagttc

SEQ ID NO: 29960 - DNA, 21 bp, Homo sapiens
atttcagtggagtgaagttca

SEQ ID NO: 29961 - DNA, 22 bp, Homo sapiens
atttcagtggagtgaagttcag

SEQ ID NO: 29962 - DNA, 19 bp, Homo sapiens
tgaggcagtagattgaatt

SEQ ID NO: 29963 - DNA, 20 bp, Homo sapiens
tgaggcagtagattgaattg

SEQ ID NO: 29964 - DNA, 21 bp, Homo sapiens
tgaggcagtagattgaattga

SEQ ID NO: 29965 - DNA, 22 bp, Homo sapiens
tgaggcagtagattgaattgat

SEQ ID NO: 29966 - DNA, 16 bp, Homo sapiens
accgcgcggctggagg

SEQ ID NO: 29967 - DNA, 18 bp, Homo sapiens
accgcgcggctggaggtg

SEQ ID NO: 29968 - DNA, 19 bp, Homo sapiens
accgcgcggctggaggtgt

SEQ ID NO: 29969 - DNA, 20 bp, Homo sapiens
accgcgcggctggaggtgtg

SEQ ID NO: 29970 - DNA, 22 bp, Homo sapiens
accgcgcggctggaggtgtgag

SEQ ID NO: 29971 - DNA, 24 bp, Homo sapiens
accgcgcggctggaggtgtgagga

SEQ ID NO: 29972 - DNA, 25 bp, Homo sapiens
accgcgcggctggaggtgtgaggat

SEQ ID NO: 29973 - DNA, 26 bp, Homo sapiens
accgcgcggctggaggtgtgaggatc

SEQ ID NO: 29974 - DNA, 19 bp, Homo sapiens
ccgcgcggctggaggtgtg

SEQ ID NO: 29975 - DNA, 22 bp, Homo sapiens
ccgcgcggctggaggtgtgagg

SEQ ID NO: 29976 - DNA, 20 bp, Homo sapiens
cgcgcggctggaggtgtgag

SEQ ID NO: 29977 - DNA, 23 bp, Homo sapiens
cgcgcggctggaggtgtgaggat

SEQ ID NO: 29978 - DNA, 25 bp, Homo sapiens
cgcgcggctggaggtgtgaggatcc

SEQ ID NO: 29979 - DNA, 26 bp, Homo sapiens
cgcgcggctggaggtgtgaggatccg

SEQ ID NO: 29980 - DNA, 21 bp, Homo sapiens
gcgcggctggaggtgtgagga

SEQ ID NO: 29981 - DNA, 25 bp, Homo sapiens
gcgcggctggaggtgtgaggatccg

SEQ ID NO: 29982 - DNA, 24 bp, Homo sapiens
cgcggctggaggtgtgaggatccg

SEQ ID NO: 29983 - DNA, 26 bp, Homo sapiens
cgcggctggaggtgtgaggatccgaa

SEQ ID NO: 29984 - DNA, 22 bp, Homo sapiens
cggctggaggtgtgaggatccg

SEQ ID NO: 29985 - DNA, 23 bp, Homo sapiens
cggctggaggtgtgaggatccga

SEQ ID NO: 29986 - DNA, 21 bp, Homo sapiens
ggctggaggtgtgaggatccg

SEQ ID NO: 29987 - DNA, 20 bp, Homo sapiens
gctggaggtgtgaggatccg

SEQ ID NO: 29988 - DNA, 22 bp, Homo sapiens
gctggaggtgtgaggatccgaa

SEQ ID NO: 29989 - DNA, 19 bp, Homo sapiens
ctggaggtgtgaggatccg

SEQ ID NO: 29990 - DNA, 18 bp, Homo sapiens
tggaggtgtgaggatccg

SEQ ID NO: 29991 - DNA, 19 bp, Homo sapiens
ggaggtgtgaggatccgaa

SEQ ID NO: 29992 - DNA, 18 bp, Homo sapiens
gaggtgtgaggatccgaa

SEQ ID NO: 29993 - DNA, 19 bp, Homo sapiens
tcaaggccagaggtcccac

SEQ ID NO: 29994 - DNA, 21 bp, Homo sapiens
tcaaggccagaggtcccacag

SEQ ID NO: 29995 - DNA, 22 bp, Homo sapiens
tcaaggccagaggtcccacagc

SEQ ID NO: 29996 - DNA, 24 bp, Homo sapiens
tcaaggccagaggtcccacagcag

SEQ ID NO: 29997 - DNA, 25 bp, Homo sapiens
tcaaggccagaggtcccacagcagg

SEQ ID NO: 29998 - DNA, 20 bp, Homo sapiens
caaggccagaggtcccacag

SEQ ID NO: 29999 - DNA, 21 bp, Homo sapiens
caaggccagaggtcccacagc

SEQ ID NO: 30000 - DNA, 22 bp, Homo sapiens
caaggccagaggtcccacagca

SEQ ID NO: 30001 - DNA, 23 bp, Homo sapiens
caaggccagaggtcccacagcag

SEQ ID NO: 30002 - DNA, 20 bp, Homo sapiens
aaggccagaggtcccacagc

SEQ ID NO: 30003 - DNA, 16 bp, Homo sapiens
gggacttctggccttg

SEQ ID NO: 30004 - DNA, 17 bp, Homo sapiens
gggacttctggccttga

SEQ ID NO: 30005 - DNA, 18 bp, Homo sapiens
gggacttctggccttgac

SEQ ID NO: 30006 - DNA, 19 bp, Homo sapiens
gggacttctggccttgact

SEQ ID NO: 30007 - DNA, 20 bp, Homo sapiens
gggacttctggccttgactt

SEQ ID NO: 30008 - DNA, 24 bp, Homo sapiens
gggacttctggccttgacttgact

SEQ ID NO: 30009 - DNA, 24 bp, Homo sapiens
gaggaaactgaagctgagagggag

SEQ ID NO: 30010 - DNA, 26 bp, Homo sapiens
gaggaaactgaagctgagagggagaa

SEQ ID NO: 30011 - DNA, 28 bp, Homo sapiens
gaggaaactgaagctgagagggagaatg

SEQ ID NO: 30012 - DNA, 23 bp, Homo sapiens
aaactgaagctgagagggagaat

SEQ ID NO: 30013 - DNA, 20 bp, Homo sapiens
actgaagctgagagggagaa

SEQ ID NO: 30014 - DNA, 22 bp, Homo sapiens
actgaagctgagagggagaatg

SEQ ID NO: 30015 - DNA, 20 bp, Homo sapiens
tgaagctgagagggagaatg

SEQ ID NO: 30016 - DNA, 19 bp, Homo sapiens
gaagctgagagggagaatg

SEQ ID NO: 30017 - DNA, 18 bp, Homo sapiens
aagctgagagggagaatg

SEQ ID NO: 30018 - DNA, 17 bp, Homo sapiens
agctgagagggagaatg

SEQ ID NO: 30019 - DNA, 21 bp, Homo sapiens
atgtttgtgcccagtactgtc

SEQ ID NO: 30020 - DNA, 23 bp, Homo sapiens
gacatgtttgtgcccagtactgt

SEQ ID NO: 30021 - DNA, 26 bp, Homo sapiens
gaccatgacctggacatgtttgtgcc

SEQ ID NO: 30022 - DNA, 18 bp, Homo sapiens
acctccgggacggctggg

SEQ ID NO: 30023 - DNA, 17 bp, Homo sapiens
cctccgggacggctggg

SEQ ID NO: 30024 - DNA, 18 bp, Homo sapiens
cctccgggacggctgggc

SEQ ID NO: 30025 - DNA, 20 bp, Homo sapiens
cctccgggacggctgggcgc

SEQ ID NO: 30026 - DNA, 16 bp, Homo sapiens
ctccgggacggctggg

SEQ ID NO: 30027 - DNA, 18 bp, Homo sapiens
ctccgggacggctgggcg

SEQ ID NO: 30028 - DNA, 19 bp, Homo sapiens
ctccgggacggctgggcgc

SEQ ID NO: 30029 - DNA, 27 bp, Homo sapiens
gcagggagaaggtggaagtgcagagtg

SEQ ID NO: 30030 - DNA, 25 bp, Homo sapiens
cagggagaaggtggaagtgcagagt

SEQ ID NO: 30031 - DNA, 24 bp, Homo sapiens
agggagaaggtggaagtgcagagt

SEQ ID NO: 30032 - DNA, 25 bp, Homo sapiens
agggagaaggtggaagtgcagagtg

SEQ ID NO: 30033 - DNA, 23 bp, Homo sapiens
ccacactgtccccttctccccag

SEQ ID NO: 30034 - DNA, 23 bp, Homo sapiens
cacactgtccccttctccccagc

SEQ ID NO: 30035 - DNA, 22 bp, Homo sapiens
acactgtccccttctccccagc

SEQ ID NO: 30036 - DNA, 23 bp, Homo sapiens
acactgtccccttctccccagcg

SEQ ID NO: 30037 - DNA, 23 bp, Homo sapiens
cactgtccccttctccccagcga

SEQ ID NO: 30038 - DNA, 16 bp, Homo sapiens
tctgagagagctcgat

SEQ ID NO: 30039 - DNA, 17 bp, Homo sapiens
tctgagagagctcgatg

SEQ ID NO: 30040 - DNA, 20 bp, Homo sapiens
tctgagagagctcgatggca

SEQ ID NO: 30041 - DNA, 22 bp, Homo sapiens
tctgagagagctcgatggcagg

SEQ ID NO: 30042 - DNA, 23 bp, Homo sapiens
tctgagagagctcgatggcaggt

SEQ ID NO: 30043 - DNA, 24 bp, Homo sapiens
tctgagagagctcgatggcaggtg

SEQ ID NO: 30044 - DNA, 19 bp, Homo sapiens
ctgagagagctcgatggca

SEQ ID NO: 30045 - DNA, 21 bp, Homo sapiens
ctgagagagctcgatggcagg

SEQ ID NO: 30046 - DNA, 22 bp, Homo sapiens
ctgagagagctcgatggcaggt

SEQ ID NO: 30047 - DNA, 23 bp, Homo sapiens
ctgagagagctcgatggcaggtg

SEQ ID NO: 30048 - DNA, 24 bp, Homo sapiens
ctgagagagctcgatggcaggtgc

SEQ ID NO: 30049 - DNA, 25 bp, Homo sapiens
ctgagagagctcgatggcaggtgcc

SEQ ID NO: 30050 - DNA, 22 bp, Homo sapiens
tgagagagctcgatggcaggtg

SEQ ID NO: 30051 - DNA, 24 bp, Homo sapiens
tgagagagctcgatggcaggtgcc

SEQ ID NO: 30052 - DNA, 19 bp, Homo sapiens
cctcctacgctgctctctc

SEQ ID NO: 30053 - DNA, 20 bp, Homo sapiens
cctcctacgctgctctctca

SEQ ID NO: 30054 - DNA, 21 bp, Homo sapiens
cctcctacgctgctctctcac

SEQ ID NO: 30055 - DNA, 22 bp, Homo sapiens
cctcctacgctgctctctcact

SEQ ID NO: 30056 - DNA, 23 bp, Homo sapiens
cctcctacgctgctctctcactc

SEQ ID NO: 30057 - DNA, 24 bp, Homo sapiens
cctcctacgctgctctctcactcc

SEQ ID NO: 30058 - DNA, 26 bp, Homo sapiens
cctcctacgctgctctctcactccag

SEQ ID NO: 30059 - DNA, 21 bp, Homo sapiens
ctcctacgctgctctctcact

SEQ ID NO: 30060 - DNA, 22 bp, Homo sapiens
ctcctacgctgctctctcactc

SEQ ID NO: 30061 - DNA, 23 bp, Homo sapiens
ctcctacgctgctctctcactcc

SEQ ID NO: 30062 - DNA, 21 bp, Homo sapiens
tcctacgctgctctctcactc

SEQ ID NO: 30063 - DNA, 23 bp, Homo sapiens
tcctacgctgctctctcactcca

SEQ ID NO: 30064 - DNA, 26 bp, Homo sapiens
tgtgtcccattattggtgatttcaga

SEQ ID NO: 30065 - DNA, 27 bp, Homo sapiens
ttgtgtcccattattggtgatttcaga

SEQ ID NO: 30066 - DNA, 23 bp, Homo sapiens
tgtgtcccattattggtgatttc

SEQ ID NO: 30067 - DNA, 24 bp, Homo sapiens
ttgtgtcccattattggtgatttc

SEQ ID NO: 30068 - DNA, 22 bp, Homo sapiens
tgtgtcccattattggtgattt

SEQ ID NO: 30069 - DNA, 22 bp, Homo sapiens
ttgtgtcccattattggtgatt

SEQ ID NO: 30070 - DNA, 19 bp, Homo sapiens
ttgtgtcccattattggtg

SEQ ID NO: 30071 - DNA, 22 bp, Homo sapiens
tggacctctcctccccaggccc

SEQ ID NO: 30072 - DNA, 21 bp, Homo sapiens
tggacctctcctccccaggcc

SEQ ID NO: 30073 - DNA, 20 bp, Homo sapiens
tggacctctcctccccaggc

SEQ ID NO: 30074 - DNA, 19 bp, Homo sapiens
tggacctctcctccccagg

SEQ ID NO: 30075 - DNA, 23 bp, Homo sapiens
cacctggacctctcctccccagg

SEQ ID NO: 30076 - DNA, 22 bp, Homo sapiens
gacacctggacctctcctcccc

SEQ ID NO: 30077 - DNA, 20 bp, Homo sapiens
gacacctggacctctcctcc

SEQ ID NO: 30078 - DNA, 18 bp, Homo sapiens
gacacctggacctctcct

SEQ ID NO: 30079 - DNA, 25 bp, Homo sapiens
actgggtaggtggggctccagggct

SEQ ID NO: 30080 - DNA, 23 bp, Homo sapiens
ctgggtaggtggggctccagggc

SEQ ID NO: 30081 - DNA, 24 bp, Homo sapiens
actgggtaggtggggctccagggc

SEQ ID NO: 30082 - DNA, 25 bp, Homo sapiens
cactgggtaggtggggctccagggc

SEQ ID NO: 30083 - DNA, 22 bp, Homo sapiens
ctgggtaggtggggctccaggg

SEQ ID NO: 30084 - DNA, 23 bp, Homo sapiens
actgggtaggtggggctccaggg

SEQ ID NO: 30085 - DNA, 24 bp, Homo sapiens
cactgggtaggtggggctccaggg

SEQ ID NO: 30086 - DNA, 25 bp, Homo sapiens
gcactgggtaggtggggctccaggg

SEQ ID NO: 30087 - DNA, 21 bp, Homo sapiens
ctgggtaggtggggctccagg

SEQ ID NO: 30088 - DNA, 23 bp, Homo sapiens
cactgggtaggtggggctccagg

SEQ ID NO: 30089 - DNA, 22 bp, Homo sapiens
cactgggtaggtggggctccag

SEQ ID NO: 30090 - DNA, 20 bp, Homo sapiens
actgggtaggtggggctcca

SEQ ID NO: 30091 - DNA, 19 bp, Homo sapiens
actgggtaggtggggctcc

SEQ ID NO: 30092 - DNA, 23 bp, Homo sapiens
cctgaatccctgtcccagcaggt

SEQ ID NO: 30093 - DNA, 22 bp, Homo sapiens
cctgaatccctgtcccagcagg

SEQ ID NO: 30094 - DNA, 23 bp, Homo sapiens
ccctgaatccctgtcccagcagg

SEQ ID NO: 30095 - DNA, 23 bp, Homo sapiens
tccctgaatccctgtcccagcag

SEQ ID NO: 30096 - DNA, 25 bp, Homo sapiens
gctccctgaatccctgtcccagcag

SEQ ID NO: 30097 - DNA, 20 bp, Homo sapiens
cctgaatccctgtcccagca

SEQ ID NO: 30098 - DNA, 22 bp, Homo sapiens
tccctgaatccctgtcccagca

SEQ ID NO: 30099 - DNA, 20 bp, Homo sapiens
ccctgaatccctgtcccagc

SEQ ID NO: 30100 - DNA, 21 bp, Homo sapiens
tccctgaatccctgtcccagc

SEQ ID NO: 30101 - DNA, 22 bp, Homo sapiens
ctccctgaatccctgtcccagc

SEQ ID NO: 30102 - DNA, 24 bp, Homo sapiens
agctccctgaatccctgtcccagc

SEQ ID NO: 30103 - DNA, 20 bp, Homo sapiens
tccctgaatccctgtcccag

SEQ ID NO: 30104 - DNA, 21 bp, Homo sapiens
ctccctgaatccctgtcccag

SEQ ID NO: 30105 - DNA, 18 bp, Homo sapiens
ggggatcttgggagtgat

SEQ ID NO: 30106 - DNA, 19 bp, Homo sapiens
aggggatcttgggagtgat

SEQ ID NO: 30107 - DNA, 22 bp, Homo sapiens
gaggaggggatcttgggagtga

SEQ ID NO: 30108 - DNA, 23 bp, Homo sapiens
tgggaggaggggatcttgggagt

SEQ ID NO: 30109 - DNA, 25 bp, Homo sapiens
tctgggaggaggggatcttgggagt

SEQ ID NO: 30110 - DNA, 24 bp, Homo sapiens
tctgggaggaggggatcttgggag

SEQ ID NO: 30111 - DNA, 25 bp, Homo sapiens
ttctgggaggaggggatcttgggag

SEQ ID NO: 30112 - DNA, 22 bp, Homo sapiens
ttctgggaggaggggatcttgg

SEQ ID NO: 30113 - DNA, 23 bp, Homo sapiens
cttctgggaggaggggatcttgg

SEQ ID NO: 30114 - DNA, 24 bp, Homo sapiens
gcttctgggaggaggggatcttgg

SEQ ID NO: 30115 - DNA, 24 bp, Homo sapiens
agccggggccatggagcagcctgt

SEQ ID NO: 30116 - DNA, 23 bp, Homo sapiens
gccggggccatggagcagcctgt

SEQ ID NO: 30117 - DNA, 24 bp, Homo sapiens
gccggggccatggagcagcctgtg

SEQ ID NO: 30118 - DNA, 25 bp, Homo sapiens
gccggggccatggagcagcctgtgt

SEQ ID NO: 30119 - DNA, 19 bp, Homo sapiens
ccggggccatggagcagcc

SEQ ID NO: 30120 - DNA, 20 bp, Homo sapiens
ccggggccatggagcagcct

SEQ ID NO: 30121 - DNA, 22 bp, Homo sapiens
ccggggccatggagcagcctgt

SEQ ID NO: 30122 - DNA, 23 bp, Homo sapiens
ccggggccatggagcagcctgtg

SEQ ID NO: 30123 - DNA, 24 bp, Homo sapiens
ccggggccatggagcagcctgtgt

SEQ ID NO: 30124 - DNA, 20 bp, Homo sapiens
cggggccatggagcagcctg

SEQ ID NO: 30125 - DNA, 21 bp, Homo sapiens
cggggccatggagcagcctgt

SEQ ID NO: 30126 - DNA, 22 bp, Homo sapiens
cggggccatggagcagcctgtg

SEQ ID NO: 30127 - DNA, 17 bp, Homo sapiens
ggccatggagcagcctg

SEQ ID NO: 30128 - DNA, 28 bp, Homo sapiens
ctcactggctgcttcccttggtctccag

SEQ ID NO: 30129 - DNA, 18 bp, Homo sapiens
ctggctgcttcccttggt

SEQ ID NO: 30130 - DNA, 19 bp, Homo sapiens
ctggctgcttcccttggtc

SEQ ID NO: 30131 - DNA, 20 bp, Homo sapiens
ctggctgcttcccttggtct

SEQ ID NO: 30132 - DNA, 21 bp, Homo sapiens
ctggctgcttcccttggtctc

SEQ ID NO: 30133 - DNA, 22 bp, Homo sapiens
ctggctgcttcccttggtctcc

SEQ ID NO: 30134 - DNA, 23 bp, Homo sapiens
ctggctgcttcccttggtctcca

SEQ ID NO: 30135 - DNA, 24 bp, Homo sapiens
ctggctgcttcccttggtctccag

SEQ ID NO: 30136 - DNA, 25 bp, Homo sapiens
ctggctgcttcccttggtctccagg

SEQ ID NO: 30137 - DNA, 26 bp, Homo sapiens
ctggctgcttcccttggtctccagga

SEQ ID NO: 30138 - DNA, 24 bp, Homo sapiens
tggctgcttcccttggtctccagg

SEQ ID NO: 30139 - DNA, 25 bp, Homo sapiens
tggctgcttcccttggtctccagga

SEQ ID NO: 30140 - DNA, 23 bp, Homo sapiens
ggctgcttcccttggtctccagg

SEQ ID NO: 30141 - DNA, 22 bp, Homo sapiens
ttgctcactgttcttccctaga

SEQ ID NO: 30142 - DNA, 23 bp, Homo sapiens
gttgctcactgttcttccctaga

SEQ ID NO: 30143 - DNA, 22 bp, Homo sapiens
caggttgctcactgttcttccc

SEQ ID NO: 30144 - DNA, 18 bp, Homo sapiens
ctcaggttgctcactgtt

SEQ ID NO: 30145 - DNA, 20 bp, Homo sapiens
gtcagctgagcatgccctca

SEQ ID NO: 30146 - DNA, 21 bp, Homo sapiens
cagggtcagctgagcatgccc

SEQ ID NO: 30147 - DNA, 28 bp, Homo sapiens
tgggctggcagggcaagtgctgcagatc

SEQ ID NO: 30148 - DNA, 24 bp, Homo sapiens
tgggctggcagggcaagtgctgca

SEQ ID NO: 30149 - DNA, 23 bp, Homo sapiens
tgggctggcagggcaagtgctgc

SEQ ID NO: 30150 - DNA, 24 bp, Homo sapiens
ctgggctggcagggcaagtgctgc

SEQ ID NO: 30151 - DNA, 21 bp, Homo sapiens
gggctggcagggcaagtgctg

SEQ ID NO: 30152 - DNA, 21 bp, Homo sapiens
tgggctggcagggcaagtgct

SEQ ID NO: 30153 - DNA, 20 bp, Homo sapiens
tgggctggcagggcaagtgc

SEQ ID NO: 30154 - DNA, 19 bp, Homo sapiens
tgggctggcagggcaagtg

SEQ ID NO: 30155 - DNA, 18 bp, Homo sapiens
gtgaggtctggggatgag

SEQ ID NO: 30156 - DNA, 22 bp, Homo sapiens
gtgaggtctggggatgaggaca

SEQ ID NO: 30157 - DNA, 21 bp, Homo sapiens
gaggtctggggatgaggacag

SEQ ID NO: 30158 - DNA, 18 bp, Homo sapiens
aggtctggggatgaggac

SEQ ID NO: 30159 - DNA, 21 bp, Homo sapiens
aggtctggggatgaggacagt

SEQ ID NO: 30160 - DNA, 22 bp, Homo sapiens
aggtctggggatgaggacagtg

SEQ ID NO: 30161 - DNA, 25 bp, Homo sapiens
aggtctggggatgaggacagtgtgt

SEQ ID NO: 30162 - DNA, 22 bp, Homo sapiens
ggtctggggatgaggacagtgt

SEQ ID NO: 30163 - DNA, 24 bp, Homo sapiens
ggtctggggatgaggacagtgtgt

SEQ ID NO: 30164 - DNA, 21 bp, Homo sapiens
gtctggggatgaggacagtgt

SEQ ID NO: 30165 - DNA, 23 bp, Homo sapiens
gtctggggatgaggacagtgtgt

SEQ ID NO: 30166 - DNA, 19 bp, Homo sapiens
tctggggatgaggacagtg

SEQ ID NO: 30167 - DNA, 23 bp, Homo sapiens
tctggggatgaggacagtgtgtc

SEQ ID NO: 30168 - DNA, 23 bp, Homo sapiens
ctggggatgaggacagtgtgtcc

SEQ ID NO: 30169 - DNA, 26 bp, Homo sapiens
ctggggatgaggacagtgtgtcctga

SEQ ID NO: 30170 - DNA, 28 bp, Homo sapiens
gaaattcacaggactgactcctcacccc

SEQ ID NO: 30171 - DNA, 27 bp, Homo sapiens
aaattcacaggactgactcctcacccc

SEQ ID NO: 30172 - DNA, 22 bp, Homo sapiens
cacaggactgactcctcacccc

SEQ ID NO: 30173 - DNA, 25 bp, Homo sapiens
cacaggactgactcctcaccccagt

SEQ ID NO: 30174 - DNA, 26 bp, Homo sapiens
acaggactgactcctcaccccagtgc

SEQ ID NO: 30175 - DNA, 26 bp, Homo sapiens
caggactgactcctcaccccagtgca

SEQ ID NO: 30176 - DNA, 25 bp, Homo sapiens
aggactgactcctcaccccagtgca

SEQ ID NO: 30177 - DNA, 26 bp, Homo sapiens
aggactgactcctcaccccagtgcac

SEQ ID NO: 30178 - DNA, 18 bp, Homo sapiens
ggactgactcctcacccc

SEQ ID NO: 30179 - DNA, 25 bp, Homo sapiens
ggactgactcctcaccccagtgcac

SEQ ID NO: 30180 - DNA, 22 bp, Homo sapiens
actgactcctcaccccagtgca

SEQ ID NO: 30181 - DNA, 18 bp, Homo sapiens
gactcctcaccccagtgc

SEQ ID NO: 30182 - DNA, 19 bp, Homo sapiens
cctcaccccagtgcacgag

SEQ ID NO: 30183 - DNA, 24 bp, Homo sapiens
cattctctctttttggcctacaag

SEQ ID NO: 30184 - DNA, 22 bp, Homo sapiens
gttcattctctctttttggcct

SEQ ID NO: 30185 - DNA, 25 bp, Homo sapiens
tctgttcattctctctttttggcct

SEQ ID NO: 30186 - DNA, 24 bp, Homo sapiens
tctgttcattctctctttttggcc

SEQ ID NO: 30187 - DNA, 23 bp, Homo sapiens
tctgttcattctctctttttggc

SEQ ID NO: 30188 - DNA, 22 bp, Homo sapiens
tctgttcattctctctttttgg

SEQ ID NO: 30189 - DNA, 22 bp, Homo sapiens
cggcctggggaggaggaagggc

SEQ ID NO: 30190 - DNA, 23 bp, Homo sapiens
tcggcctggggaggaggaagggc

SEQ ID NO: 30191 - DNA, 21 bp, Homo sapiens
tcggcctggggaggaggaagg

SEQ ID NO: 30192 - DNA, 20 bp, Homo sapiens
tcggcctggggaggaggaag

SEQ ID NO: 30193 - DNA, 19 bp, Homo sapiens
gttgggacaagaggacggt

SEQ ID NO: 30194 - DNA, 20 bp, Homo sapiens
gttgggacaagaggacggtc

SEQ ID NO: 30195 - DNA, 21 bp, Homo sapiens
gttgggacaagaggacggtct

SEQ ID NO: 30196 - DNA, 23 bp, Homo sapiens
gttgggacaagaggacggtcttc

SEQ ID NO: 30197 - DNA, 21 bp, Homo sapiens
tgggacaagaggacggtcttc

SEQ ID NO: 30198 - DNA, 22 bp, Homo sapiens
tgggacaagaggacggtcttct

SEQ ID NO: 30199 - DNA, 19 bp, Homo sapiens
gggacaagaggacggtctt

SEQ ID NO: 30200 - DNA, 20 bp, Homo sapiens
gggacaagaggacggtcttc

SEQ ID NO: 30201 - DNA, 16 bp, Homo sapiens
aggtaggcagagcagg

SEQ ID NO: 30202 - DNA, 17 bp, Homo sapiens
gaggtaggcagagcagg

SEQ ID NO: 30203 - DNA, 18 bp, Homo sapiens
ggaggtaggcagagcagg

SEQ ID NO: 30204 - DNA, 19 bp, Homo sapiens
gggaggtaggcagagcagg

SEQ ID NO: 30205 - DNA, 23 bp, Homo sapiens
ggcggggaggtaggcagagcagg

SEQ ID NO: 30206 - DNA, 24 bp, Homo sapiens
cggcggggaggtaggcagagcagg

SEQ ID NO: 30207 - DNA, 25 bp, Homo sapiens
gcggcggggaggtaggcagagcagg

SEQ ID NO: 30208 - DNA, 28 bp, Homo sapiens
atggcggcggggaggtaggcagagcagg

SEQ ID NO: 30209 - DNA, 22 bp, Homo sapiens
ggcggggaggtaggcagagcag

SEQ ID NO: 30210 - DNA, 23 bp, Homo sapiens
cggcggggaggtaggcagagcag

SEQ ID NO: 30211 - DNA, 22 bp, Homo sapiens
cggcggggaggtaggcagagca

SEQ ID NO: 30212 - DNA, 21 bp, Homo sapiens
cggcggggaggtaggcagagc

SEQ ID NO: 30213 - DNA, 20 bp, Homo sapiens
cggcggggaggtaggcagag

SEQ ID NO: 30214 - DNA, 19 bp, Homo sapiens
cggcggggaggtaggcaga

SEQ ID NO: 30215 - DNA, 20 bp, Homo sapiens
gcggcggggaggtaggcaga

SEQ ID NO: 30216 - DNA, 21 bp, Homo sapiens
ggcggcggggaggtaggcaga

SEQ ID NO: 30217 - DNA, 23 bp, Homo sapiens
atggcggcggggaggtaggcaga

SEQ ID NO: 30218 - DNA, 25 bp, Homo sapiens
agatggcggcggggaggtaggcaga

SEQ ID NO: 30219 - DNA, 26 bp, Homo sapiens
aagatggcggcggggaggtaggcaga

SEQ ID NO: 30220 - DNA, 17 bp, Homo sapiens
tggcggcggggaggtag

SEQ ID NO: 30221 - DNA, 20 bp, Homo sapiens
agatggcggcggggaggtag

SEQ ID NO: 30222 - DNA, 23 bp, Homo sapiens
ctgagcaatgtaggtagactgtt

SEQ ID NO: 30223 - DNA, 23 bp, Homo sapiens
tgagcaatgtaggtagactgttt

SEQ ID NO: 30224 - DNA, 24 bp, Homo sapiens
tgagcaatgtaggtagactgtttc

SEQ ID NO: 30225 - DNA, 21 bp, Homo sapiens
gagcaatgtaggtagactgtt

SEQ ID NO: 30226 - DNA, 23 bp, Homo sapiens
gagcaatgtaggtagactgtttc

SEQ ID NO: 30227 - DNA, 27 bp, Homo sapiens
ccgccttctctcctcccccaggtccac

SEQ ID NO: 30228 - DNA, 24 bp, Homo sapiens
ccgccttctctcctcccccaggtc

SEQ ID NO: 30229 - DNA, 23 bp, Homo sapiens
ccgccttctctcctcccccaggt

SEQ ID NO: 30230 - DNA, 27 bp, Homo sapiens
ctgaccgccttctctcctcccccaggt

SEQ ID NO: 30231 - DNA, 22 bp, Homo sapiens
ccgccttctctcctcccccagg

SEQ ID NO: 30232 - DNA, 23 bp, Homo sapiens
accgccttctctcctcccccagg

SEQ ID NO: 30233 - DNA, 24 bp, Homo sapiens
gaccgccttctctcctcccccagg

SEQ ID NO: 30234 - DNA, 19 bp, Homo sapiens
ccgccttctctcctccccc

SEQ ID NO: 30235 - DNA, 18 bp, Homo sapiens
agagggcagctcccatga

SEQ ID NO: 30236 - DNA, 25 bp, Homo sapiens
gtggtggaggaagagggcagctccc

SEQ ID NO: 30237 - DNA, 23 bp, Homo sapiens
tggtggaggaagagggcagctcc

SEQ ID NO: 30238 - DNA, 23 bp, Homo sapiens
gtggtggaggaagagggcagctc

SEQ ID NO: 30239 - DNA, 22 bp, Homo sapiens
gtggtggaggaagagggcagct

SEQ ID NO: 30240 - DNA, 20 bp, Homo sapiens
gtggtggaggaagagggcag

SEQ ID NO: 30241 - DNA, 19 bp, Homo sapiens
gtggtggaggaagagggca

SEQ ID NO: 30242 - DNA, 22 bp, Homo sapiens
ttcaataatcggacccatttaa

SEQ ID NO: 30243 - DNA, 24 bp, Homo sapiens
ttcaataatcggacccatttaaac

SEQ ID NO: 30244 - DNA, 25 bp, Homo sapiens
ttcaataatcggacccatttaaacc

SEQ ID NO: 30245 - DNA, 22 bp, Homo sapiens
tcaataatcggacccatttaaa

SEQ ID NO: 30246 - DNA, 23 bp, Homo sapiens
ataatcggacccatttaaaccgg

SEQ ID NO: 30247 - DNA, 19 bp, Homo sapiens
aatcggacccatttaaacc

SEQ ID NO: 30248 - DNA, 21 bp, Homo sapiens
aatcggacccatttaaaccgg

SEQ ID NO: 30249 - DNA, 22 bp, Homo sapiens
aatcggacccatttaaaccgga

SEQ ID NO: 30250 - DNA, 25 bp, Homo sapiens
aatcggacccatttaaaccggagat

SEQ ID NO: 30251 - DNA, 21 bp, Homo sapiens
atcggacccatttaaaccgga

SEQ ID NO: 30252 - DNA, 22 bp, Homo sapiens
atcggacccatttaaaccggag

SEQ ID NO: 30253 - DNA, 23 bp, Homo sapiens
atcggacccatttaaaccggaga

SEQ ID NO: 30254 - DNA, 24 bp, Homo sapiens
atcggacccatttaaaccggagat

SEQ ID NO: 30255 - DNA, 25 bp, Homo sapiens
atcggacccatttaaaccggagatt

SEQ ID NO: 30256 - DNA, 20 bp, Homo sapiens
tcggacccatttaaaccgga

SEQ ID NO: 30257 - DNA, 21 bp, Homo sapiens
tcggacccatttaaaccggag

SEQ ID NO: 30258 - DNA, 22 bp, Homo sapiens
tcggacccatttaaaccggaga

SEQ ID NO: 30259 - DNA, 24 bp, Homo sapiens
tcggacccatttaaaccggagatt

SEQ ID NO: 30260 - DNA, 22 bp, Homo sapiens
ggacccatttaaaccggagatt

SEQ ID NO: 30261 - DNA, 19 bp, Homo sapiens
aggaggcatcttgagaaat

SEQ ID NO: 30262 - DNA, 21 bp, Homo sapiens
aggaggcatcttgagaaatgg

SEQ ID NO: 30263 - DNA, 23 bp, Homo sapiens
aggaggcatcttgagaaatggaa

SEQ ID NO: 30264 - DNA, 24 bp, Homo sapiens
aggaggcatcttgagaaatggaag

SEQ ID NO: 30265 - DNA, 18 bp, Homo sapiens
tgcactgaacgcctgttc

SEQ ID NO: 30266 - DNA, 26 bp, Homo sapiens
ctgaacgcctgttcttgccaggtggc

SEQ ID NO: 30267 - DNA, 28 bp, Homo sapiens
ctgaacgcctgttcttgccaggtggcag

SEQ ID NO: 30268 - DNA, 18 bp, Homo sapiens
gaacgcctgttcttgcca

SEQ ID NO: 30269 - DNA, 17 bp, Homo sapiens
ttcttgccaggtggcag

SEQ ID NO: 30270 - DNA, 18 bp, Homo sapiens
cttgccaggtggcagaag

SEQ ID NO: 30271 - DNA, 19 bp, Homo sapiens
cttctcactagctgtgaaa

SEQ ID NO: 30272 - DNA, 24 bp, Homo sapiens
aggcattgacttctcactagctgt

SEQ ID NO: 30273 - DNA, 23 bp, Homo sapiens
aggcattgacttctcactagctg

SEQ ID NO: 30274 - DNA, 23 bp, Homo sapiens
ctcctggggagtggctggggagc

SEQ ID NO: 30275 - DNA, 24 bp, Homo sapiens
ctcctggggagtggctggggagca

SEQ ID NO: 30276 - DNA, 21 bp, Homo sapiens
tcctggggagtggctggggag

SEQ ID NO: 30277 - DNA, 22 bp, Homo sapiens
tcctggggagtggctggggagc

SEQ ID NO: 30278 - DNA, 23 bp, Homo sapiens
tcctggggagtggctggggagca

SEQ ID NO: 30279 - DNA, 24 bp, Homo sapiens
tcctggggagtggctggggagcag

SEQ ID NO: 30280 - DNA, 19 bp, Homo sapiens
cctggggagtggctgggga

SEQ ID NO: 30281 - DNA, 20 bp, Homo sapiens
cctggggagtggctggggag

SEQ ID NO: 30282 - DNA, 21 bp, Homo sapiens
cctggggagtggctggggagc

SEQ ID NO: 30283 - DNA, 22 bp, Homo sapiens
cctggggagtggctggggagca

SEQ ID NO: 30284 - DNA, 23 bp, Homo sapiens
cctggggagtggctggggagcag

SEQ ID NO: 30285 - DNA, 24 bp, Homo sapiens
cctggggagtggctggggagcaga

SEQ ID NO: 30286 - DNA, 20 bp, Homo sapiens
ctggggagtggctggggagc

SEQ ID NO: 30287 - DNA, 21 bp, Homo sapiens
ctggggagtggctggggagca

SEQ ID NO: 30288 - DNA, 22 bp, Homo sapiens
ctggggagtggctggggagcag

SEQ ID NO: 30289 - DNA, 22 bp, Homo sapiens
tggggagtggctggggagcaga

SEQ ID NO: 30290 - DNA, 22 bp, Homo sapiens
tgctccccggcctctgccccca

SEQ ID NO: 30291 - DNA, 19 bp, Homo sapiens
ctccccggcctctgccccc

SEQ ID NO: 30292 - DNA, 20 bp, Homo sapiens
ctccccggcctctgccccca

SEQ ID NO: 30293 - DNA, 22 bp, Homo sapiens
ctccccggcctctgcccccagc

SEQ ID NO: 30294 - DNA, 23 bp, Homo sapiens
ctccccggcctctgcccccagct

SEQ ID NO: 30295 - DNA, 24 bp, Homo sapiens
ctccccggcctctgcccccagctc

SEQ ID NO: 30296 - DNA, 17 bp, Homo sapiens
gagtgtctaagcacagg

SEQ ID NO: 30297 - DNA, 21 bp, Homo sapiens
acctgagtgtctaagcacagg

SEQ ID NO: 30298 - DNA, 21 bp, Homo sapiens
aaacacagggacctgagtgtc

SEQ ID NO: 30299 - DNA, 18 bp, Homo sapiens
aaacacagggacctgagt

SEQ ID NO: 30300 - DNA, 22 bp, Homo sapiens
gtcattgtaaggttaatgcacc

SEQ ID NO: 30301 - DNA, 17 bp, Homo sapiens
gtaaggttaatgcaccc

SEQ ID NO: 30302 - DNA, 18 bp, Homo sapiens
gtaaggttaatgcaccca

SEQ ID NO: 30303 - DNA, 19 bp, Homo sapiens
gtaaggttaatgcacccat

SEQ ID NO: 30304 - DNA, 26 bp, Homo sapiens
tctgtcatttctttaggccaatattc

SEQ ID NO: 30305 - DNA, 25 bp, Homo sapiens
tctgtcatttctttaggccaatatt

SEQ ID NO: 30306 - DNA, 22 bp, Homo sapiens
tgtcatttctttaggccaatat

SEQ ID NO: 30307 - DNA, 24 bp, Homo sapiens
tctgtcatttctttaggccaatat

SEQ ID NO: 30308 - DNA, 22 bp, Homo sapiens
tctgtcatttctttaggccaat

SEQ ID NO: 30309 - DNA, 21 bp, Homo sapiens
tctgtcatttctttaggccaa

SEQ ID NO: 30310 - DNA, 20 bp, Homo sapiens
tctgtcatttctttaggcca

SEQ ID NO: 30311 - DNA, 19 bp, Homo sapiens
tctgtcatttctttaggcc

SEQ ID NO: 30312 - DNA, 24 bp, Homo sapiens
tgacctatgaattgacagacaata

SEQ ID NO: 30313 - DNA, 25 bp, Homo sapiens
atgacctatgaattgacagacaata

SEQ ID NO: 30314 - DNA, 23 bp, Homo sapiens
atgacctatgaattgacagacaa

SEQ ID NO: 30315 - DNA, 22 bp, Homo sapiens
atgacctatgaattgacagaca

SEQ ID NO: 30316 - DNA, 20 bp, Homo sapiens
tgacctatgaattgacagac

SEQ ID NO: 30317 - DNA, 19 bp, Homo sapiens
tgacctatgaattgacaga

SEQ ID NO: 30318 - DNA, 20 bp, Homo sapiens
atgacctatgaattgacaga

SEQ ID NO: 30319 - DNA, 27 bp, Homo sapiens
gtaacagcaactccatgtggactgtgt

SEQ ID NO: 30320 - DNA, 28 bp, Homo sapiens
tgtaacagcaactccatgtggactgtgt

SEQ ID NO: 30321 - DNA, 27 bp, Homo sapiens
tgtaacagcaactccatgtggactgtg

SEQ ID NO: 30322 - DNA, 24 bp, Homo sapiens
gtaacagcaactccatgtggactg

SEQ ID NO: 30323 - DNA, 25 bp, Homo sapiens
tgtaacagcaactccatgtggactg

SEQ ID NO: 30324 - DNA, 23 bp, Homo sapiens
gtaacagcaactccatgtggact

SEQ ID NO: 30325 - DNA, 24 bp, Homo sapiens
tgtaacagcaactccatgtggact

SEQ ID NO: 30326 - DNA, 22 bp, Homo sapiens
gtaacagcaactccatgtggac

SEQ ID NO: 30327 - DNA, 23 bp, Homo sapiens
tgtaacagcaactccatgtggac

SEQ ID NO: 30328 - DNA, 23 bp, Homo sapiens
gtgtaacagcaactccatgtgga

SEQ ID NO: 30329 - DNA, 28 bp, Homo sapiens
atcaagtgtaacagcaactccatgtgga

SEQ ID NO: 30330 - DNA, 21 bp, Homo sapiens
agtgtaacagcaactccatgt

SEQ ID NO: 30331 - DNA, 26 bp, Homo sapiens
tattcatttatccccagcctacaaaa

SEQ ID NO: 30332 - DNA, 25 bp, Homo sapiens
tattcatttatccccagcctacaaa

SEQ ID NO: 30333 - DNA, 24 bp, Homo sapiens
tattcatttatccccagcctacaa

SEQ ID NO: 30334 - DNA, 22 bp, Homo sapiens
attcatttatccccagcctaca

SEQ ID NO: 30335 - DNA, 22 bp, Homo sapiens
tattcatttatccccagcctac

SEQ ID NO: 30336 - DNA, 20 bp, Homo sapiens
attcatttatccccagccta

SEQ ID NO: 30337 - DNA, 21 bp, Homo sapiens
tattcatttatccccagccta

SEQ ID NO: 30338 - DNA, 20 bp, Homo sapiens
tattcatttatccccagcct

SEQ ID NO: 30339 - DNA, 19 bp, Homo sapiens
tattcatttatccccagcc

SEQ ID NO: 30340 - DNA, 26 bp, Homo sapiens
tggctagggaaaatgattggatagaa

SEQ ID NO: 30341 - DNA, 23 bp, Homo sapiens
tggctagggaaaatgattggata

SEQ ID NO: 30342 - DNA, 24 bp, Homo sapiens
ctggctagggaaaatgattggata

SEQ ID NO: 30343 - DNA, 25 bp, Homo sapiens
actggctagggaaaatgattggata

SEQ ID NO: 30344 - DNA, 23 bp, Homo sapiens
ctggctagggaaaatgattggat

SEQ ID NO: 30345 - DNA, 22 bp, Homo sapiens
ctggctagggaaaatgattgga

SEQ ID NO: 30346 - DNA, 23 bp, Homo sapiens
actggctagggaaaatgattgga

SEQ ID NO: 30347 - DNA, 21 bp, Homo sapiens
ctggctagggaaaatgattgg

SEQ ID NO: 30348 - DNA, 22 bp, Homo sapiens
actggctagggaaaatgattgg

SEQ ID NO: 30349 - DNA, 21 bp, Homo sapiens
actggctagggaaaatgattg

SEQ ID NO: 30350 - DNA, 19 bp, Homo sapiens
ctggctagggaaaatgatt

SEQ ID NO: 30351 - DNA, 20 bp, Homo sapiens
actggctagggaaaatgatt

SEQ ID NO: 30352 - DNA, 17 bp, Homo sapiens
attgaaactggctaggg

SEQ ID NO: 30353 - DNA, 19 bp, Homo sapiens
gggagctgtggaagcagta

SEQ ID NO: 30354 - DNA, 18 bp, Homo sapiens
ggagctgtggaagcagta

SEQ ID NO: 30355 - DNA, 26 bp, Homo sapiens
aaagctgggttgagagggcaaaagga

SEQ ID NO: 30356 - DNA, 27 bp, Homo sapiens
aaaagctgggttgagagggcaaaagga

SEQ ID NO: 30357 - DNA, 24 bp, Homo sapiens
aagctgggttgagagggcaaaagg

SEQ ID NO: 30358 - DNA, 26 bp, Homo sapiens
aaaagctgggttgagagggcaaaagg

SEQ ID NO: 30359 - DNA, 23 bp, Homo sapiens
aagctgggttgagagggcaaaag

SEQ ID NO: 30360 - DNA, 25 bp, Homo sapiens
aaaagctgggttgagagggcaaaag

SEQ ID NO: 30361 - DNA, 22 bp, Homo sapiens
aagctgggttgagagggcaaaa

SEQ ID NO: 30362 - DNA, 23 bp, Homo sapiens
aaagctgggttgagagggcaaaa

SEQ ID NO: 30363 - DNA, 24 bp, Homo sapiens
aaaagctgggttgagagggcaaaa

SEQ ID NO: 30364 - DNA, 25 bp, Homo sapiens
gaaaagctgggttgagagggcaaaa

SEQ ID NO: 30365 - DNA, 23 bp, Homo sapiens
tgtattctcctttgcctgcaggg

SEQ ID NO: 30366 - DNA, 22 bp, Homo sapiens
tgtattctcctttgcctgcagg

SEQ ID NO: 30367 - DNA, 24 bp, Homo sapiens
tctgtattctcctttgcctgcagg

SEQ ID NO: 30368 - DNA, 22 bp, Homo sapiens
ctgtattctcctttgcctgcag

SEQ ID NO: 30369 - DNA, 22 bp, Homo sapiens
tctgtattctcctttgcctgca

SEQ ID NO: 30370 - DNA, 19 bp, Homo sapiens
tgtattctcctttgcctgc

SEQ ID NO: 30371 - DNA, 21 bp, Homo sapiens
tctgtattctcctttgcctgc

SEQ ID NO: 30372 - DNA, 20 bp, Homo sapiens
tctgtattctcctttgcctg

SEQ ID NO: 30373 - DNA, 24 bp, Homo sapiens
caggcaaagggatatttacagata

SEQ ID NO: 30374 - DNA, 25 bp, Homo sapiens
tcaggcaaagggatatttacagata

SEQ ID NO: 30375 - DNA, 26 bp, Homo sapiens
atcaggcaaagggatatttacagata

SEQ ID NO: 30376 - DNA, 24 bp, Homo sapiens
tcaggcaaagggatatttacagat

SEQ ID NO: 30377 - DNA, 22 bp, Homo sapiens
caggcaaagggatatttacaga

SEQ ID NO: 30378 - DNA, 24 bp, Homo sapiens
atcaggcaaagggatatttacaga

SEQ ID NO: 30379 - DNA, 25 bp, Homo sapiens
catcaggcaaagggatatttacaga

SEQ ID NO: 30380 - DNA, 22 bp, Homo sapiens
tcaggcaaagggatatttacag

SEQ ID NO: 30381 - DNA, 23 bp, Homo sapiens
atcaggcaaagggatatttacag

SEQ ID NO: 30382 - DNA, 21 bp, Homo sapiens
tcaggcaaagggatatttaca

SEQ ID NO: 30383 - DNA, 22 bp, Homo sapiens
atcaggcaaagggatatttaca

SEQ ID NO: 30384 - DNA, 19 bp, Homo sapiens
tcaggcaaagggatattta

SEQ ID NO: 30385 - DNA, 22 bp, Homo sapiens
cactgcaggactcagcaggaat

SEQ ID NO: 30386 - DNA, 24 bp, Homo sapiens
accagtgtggctcagcgaggtggc

SEQ ID NO: 30387 - DNA, 22 bp, Homo sapiens
ccagtgtggctcagcgaggtgg

SEQ ID NO: 30388 - DNA, 23 bp, Homo sapiens
accagtgtggctcagcgaggtgg

SEQ ID NO: 30389 - DNA, 22 bp, Homo sapiens
accagtgtggctcagcgaggtg

SEQ ID NO: 30390 - DNA, 21 bp, Homo sapiens
accagtgtggctcagcgaggt

SEQ ID NO: 30391 - DNA, 20 bp, Homo sapiens
accagtgtggctcagcgagg

SEQ ID NO: 30392 - DNA, 19 bp, Homo sapiens
accagtgtggctcagcgag

SEQ ID NO: 30393 - DNA, 18 bp, Homo sapiens
accagtgtggctcagcga

SEQ ID NO: 30394 - DNA, 26 bp, Homo sapiens
tcggctctctccctcaccctagaagc

SEQ ID NO: 30395 - DNA, 23 bp, Homo sapiens
cggctctctccctcaccctagaa

SEQ ID NO: 30396 - DNA, 24 bp, Homo sapiens
tcggctctctccctcaccctagaa

SEQ ID NO: 30397 - DNA, 22 bp, Homo sapiens
cggctctctccctcaccctaga

SEQ ID NO: 30398 - DNA, 23 bp, Homo sapiens
tcggctctctccctcaccctaga

SEQ ID NO: 30399 - DNA, 21 bp, Homo sapiens
cggctctctccctcaccctag

SEQ ID NO: 30400 - DNA, 20 bp, Homo sapiens
cggctctctccctcacccta

SEQ ID NO: 30401 - DNA, 21 bp, Homo sapiens
tcggctctctccctcacccta

SEQ ID NO: 30402 - DNA, 20 bp, Homo sapiens
tcggctctctccctcaccct

SEQ ID NO: 30403 - DNA, 25 bp, Homo sapiens
gtgggtgctggtgggagccgtgccc

SEQ ID NO: 30404 - DNA, 24 bp, Homo sapiens
gtgggtgctggtgggagccgtgcc

SEQ ID NO: 30405 - DNA, 25 bp, Homo sapiens
ggtgggtgctggtgggagccgtgcc

SEQ ID NO: 30406 - DNA, 19 bp, Homo sapiens
gtgctggtgggagccgtgc

SEQ ID NO: 30407 - DNA, 23 bp, Homo sapiens
gtgggtgctggtgggagccgtgc

SEQ ID NO: 30408 - DNA, 23 bp, Homo sapiens
ggtgggtgctggtgggagccgtg

SEQ ID NO: 30409 - DNA, 19 bp, Homo sapiens
gggtgctggtgggagccgt

SEQ ID NO: 30410 - DNA, 20 bp, Homo sapiens
tgggtgctggtgggagccgt

SEQ ID NO: 30411 - DNA, 21 bp, Homo sapiens
gtgggtgctggtgggagccgt

SEQ ID NO: 30412 - DNA, 22 bp, Homo sapiens
ggtgggtgctggtgggagccgt

SEQ ID NO: 30413 - DNA, 23 bp, Homo sapiens
gggtgggtgctggtgggagccgt

SEQ ID NO: 30414 - DNA, 20 bp, Homo sapiens
gtgggtgctggtgggagccg

SEQ ID NO: 30415 - DNA, 19 bp, Homo sapiens
gtgggtgctggtgggagcc

SEQ ID NO: 30416 - DNA, 18 bp, Homo sapiens
gtgggtgctggtgggagc

SEQ ID NO: 30417 - DNA, 17 bp, Homo sapiens
cagggcctcgcctgtcc

SEQ ID NO: 30418 - DNA, 18 bp, Homo sapiens
ccagggcctcgcctgtcc

SEQ ID NO: 30419 - DNA, 23 bp, Homo sapiens
gtgctcccagggcctcgcctgtc

SEQ ID NO: 30420 - DNA, 22 bp, Homo sapiens
gtgctcccagggcctcgcctgt

SEQ ID NO: 30421 - DNA, 23 bp, Homo sapiens
tgtgctcccagggcctcgcctgt

SEQ ID NO: 30422 - DNA, 24 bp, Homo sapiens
cctgtgctcccagggcctcgcctg

SEQ ID NO: 30423 - DNA, 22 bp, Homo sapiens
cctgtgctcccagggcctcgcc

SEQ ID NO: 30424 - DNA, 24 bp, Homo sapiens
tgaggcccttggggcacagtggtg

SEQ ID NO: 30425 - DNA, 23 bp, Homo sapiens
tgaggcccttggggcacagtggt

SEQ ID NO: 30426 - DNA, 24 bp, Homo sapiens
gtgaggcccttggggcacagtggt

SEQ ID NO: 30427 - DNA, 21 bp, Homo sapiens
gaggcccttggggcacagtgg

SEQ ID NO: 30428 - DNA, 21 bp, Homo sapiens
tgaggcccttggggcacagtg

SEQ ID NO: 30429 - DNA, 19 bp, Homo sapiens
tgaggcccttggggcacag

SEQ ID NO: 30430 - DNA, 23 bp, Homo sapiens
tcaggtgaggcccttggggcaca

SEQ ID NO: 30431 - DNA, 17 bp, Homo sapiens
aggtgaggcccttgggg

SEQ ID NO: 30432 - DNA, 22 bp, Homo sapiens
cagggagtgggctgggctgggc

SEQ ID NO: 30433 - DNA, 23 bp, Homo sapiens
cagggagtgggctgggctgggct

SEQ ID NO: 30434 - DNA, 24 bp, Homo sapiens
cagggagtgggctgggctgggctg

SEQ ID NO: 30435 - DNA, 21 bp, Homo sapiens
agggagtgggctgggctgggc

SEQ ID NO: 30436 - DNA, 23 bp, Homo sapiens
agggagtgggctgggctgggctg

SEQ ID NO: 30437 - DNA, 24 bp, Homo sapiens
agggagtgggctgggctgggctgg

SEQ ID NO: 30438 - DNA, 23 bp, Homo sapiens
gggagtgggctgggctgggctgg

SEQ ID NO: 30439 - DNA, 26 bp, Homo sapiens
gggagtgggctgggctgggctgggcc

SEQ ID NO: 30440 - DNA, 23 bp, Homo sapiens
agtgggctgggctgggctgggcc

SEQ ID NO: 30441 - DNA, 20 bp, Homo sapiens
gtgggctgggctgggctggg

SEQ ID NO: 30442 - DNA, 23 bp, Homo sapiens
gtgggctgggctgggctgggcca

SEQ ID NO: 30443 - DNA, 23 bp, Homo sapiens
ctgggctgggctgggccaaggta

SEQ ID NO: 30444 - DNA, 24 bp, Homo sapiens
cctcaccctgcatcccgcacccag

SEQ ID NO: 30445 - DNA, 25 bp, Homo sapiens
cctcaccctgcatcccgcacccagg

SEQ ID NO: 30446 - DNA, 24 bp, Homo sapiens
ctcaccctgcatcccgcacccagg

SEQ ID NO: 30447 - DNA, 17 bp, Homo sapiens
tcaccctgcatcccgca

SEQ ID NO: 30448 - DNA, 20 bp, Homo sapiens
tcaccctgcatcccgcaccc

SEQ ID NO: 30449 - DNA, 21 bp, Homo sapiens
tcaccctgcatcccgcaccca

SEQ ID NO: 30450 - DNA, 23 bp, Homo sapiens
tcaccctgcatcccgcacccagg

SEQ ID NO: 30451 - DNA, 24 bp, Homo sapiens
tcaccctgcatcccgcacccaggc

SEQ ID NO: 30452 - DNA, 21 bp, Homo sapiens
caccctgcatcccgcacccag

SEQ ID NO: 30453 - DNA, 22 bp, Homo sapiens
caccctgcatcccgcacccagg

SEQ ID NO: 30454 - DNA, 23 bp, Homo sapiens
acctgggttgtcccctctagggt

SEQ ID NO: 30455 - DNA, 25 bp, Homo sapiens
acacctgggttgtcccctctagggt

SEQ ID NO: 30456 - DNA, 22 bp, Homo sapiens
acctgggttgtcccctctaggg

SEQ ID NO: 30457 - DNA, 23 bp, Homo sapiens
cacctgggttgtcccctctaggg

SEQ ID NO: 30458 - DNA, 21 bp, Homo sapiens
acctgggttgtcccctctagg

SEQ ID NO: 30459 - DNA, 22 bp, Homo sapiens
cacctgggttgtcccctctagg

SEQ ID NO: 30460 - DNA, 23 bp, Homo sapiens
acacctgggttgtcccctctagg

SEQ ID NO: 30461 - DNA, 21 bp, Homo sapiens
cacctgggttgtcccctctag

SEQ ID NO: 30462 - DNA, 22 bp, Homo sapiens
acacctgggttgtcccctctag

SEQ ID NO: 30463 - DNA, 18 bp, Homo sapiens
acctgggttgtcccctct

SEQ ID NO: 30464 - DNA, 19 bp, Homo sapiens
cacctgggttgtcccctct

SEQ ID NO: 30465 - DNA, 16 bp, Homo sapiens
cccagctgttggccat

SEQ ID NO: 30466 - DNA, 23 bp, Homo sapiens
gtggggtgggacccagctgttgg

SEQ ID NO: 30467 - DNA, 21 bp, Homo sapiens
tggggtgggacccagctgttg

SEQ ID NO: 30468 - DNA, 22 bp, Homo sapiens
gtggggtgggacccagctgttg

SEQ ID NO: 30469 - DNA, 23 bp, Homo sapiens
agtggggtgggacccagctgttg

SEQ ID NO: 30470 - DNA, 24 bp, Homo sapiens
gagtggggtgggacccagctgttg

SEQ ID NO: 30471 - DNA, 23 bp, Homo sapiens
gagtggggtgggacccagctgtt

SEQ ID NO: 30472 - DNA, 21 bp, Homo sapiens
agtggggtgggacccagctgt

SEQ ID NO: 30473 - DNA, 22 bp, Homo sapiens
gagtggggtgggacccagctgt

SEQ ID NO: 30474 - DNA, 20 bp, Homo sapiens
agtggggtgggacccagctg

SEQ ID NO: 30475 - DNA, 22 bp, Homo sapiens
acttaaatacatgtcagattgt

SEQ ID NO: 30476 - DNA, 25 bp, Homo sapiens
acttaaatacatgtcagattgtatg

SEQ ID NO: 30477 - DNA, 22 bp, Homo sapiens
atacatgtcagattgtatgcct

SEQ ID NO: 30478 - DNA, 21 bp, Homo sapiens
tacatgtcagattgtatgcct

SEQ ID NO: 30479 - DNA, 21 bp, Homo sapiens
acatgtcagattgtatgccta

SEQ ID NO: 30480 - DNA, 22 bp, Homo sapiens
catgtcagattgtatgcctaca

SEQ ID NO: 30481 - DNA, 21 bp, Homo sapiens
ctggcatacaatctgacatgt

SEQ ID NO: 30482 - DNA, 22 bp, Homo sapiens
ctggcatacaatctgacatgta

SEQ ID NO: 30483 - DNA, 20 bp, Homo sapiens
tggcatacaatctgacatgt

SEQ ID NO: 30484 - DNA, 22 bp, Homo sapiens
tggcatacaatctgacatgtat

SEQ ID NO: 30485 - DNA, 19 bp, Homo sapiens
ctctctactgacttgcaac

SEQ ID NO: 30486 - DNA, 20 bp, Homo sapiens
ctctctactgacttgcaaca

SEQ ID NO: 30487 - DNA, 21 bp, Homo sapiens
ctctctactgacttgcaacat

SEQ ID NO: 30488 - DNA, 23 bp, Homo sapiens
ctctctactgacttgcaacatac

SEQ ID NO: 30489 - DNA, 18 bp, Homo sapiens
tgttgcaagtcggtggag

SEQ ID NO: 30490 - DNA, 19 bp, Homo sapiens
tgttgcaagtcggtggaga

SEQ ID NO: 30491 - DNA, 20 bp, Homo sapiens
tgttgcaagtcggtggagac

SEQ ID NO: 30492 - DNA, 21 bp, Homo sapiens
tgttgcaagtcggtggagacg

SEQ ID NO: 30493 - DNA, 23 bp, Homo sapiens
tgttgcaagtcggtggagacgta

SEQ ID NO: 30494 - DNA, 24 bp, Homo sapiens
tgttgcaagtcggtggagacgtac

SEQ ID NO: 30495 - DNA, 25 bp, Homo sapiens
tgttgcaagtcggtggagacgtacc

SEQ ID NO: 30496 - DNA, 21 bp, Homo sapiens
gttgcaagtcggtggagacgt

SEQ ID NO: 30497 - DNA, 22 bp, Homo sapiens
gttgcaagtcggtggagacgta

SEQ ID NO: 30498 - DNA, 25 bp, Homo sapiens
ggtcttgggagggatgtgactgttg

SEQ ID NO: 30499 - DNA, 20 bp, Homo sapiens
ggtcttgggagggatgtgac

SEQ ID NO: 30500 - DNA, 21 bp, Homo sapiens
gggtcttgggagggatgtgac

SEQ ID NO: 30501 - DNA, 22 bp, Homo sapiens
agggtcttgggagggatgtgac

SEQ ID NO: 30502 - DNA, 18 bp, Homo sapiens
atatgggtttactagttg

SEQ ID NO: 30503 - DNA, 19 bp, Homo sapiens
atatgggtttactagttgg

SEQ ID NO: 30504 - DNA, 21 bp, Homo sapiens
atatgggtttactagttggtg

SEQ ID NO: 30505 - DNA, 22 bp, Homo sapiens
atatgggtttactagttggtgg

SEQ ID NO: 30506 - DNA, 22 bp, Homo sapiens
gtctgaatagagtctgaagagt

SEQ ID NO: 30507 - DNA, 20 bp, Homo sapiens
tctgaatagagtctgaagag

SEQ ID NO: 30508 - DNA, 22 bp, Homo sapiens
tctgaatagagtctgaagagtc

SEQ ID NO: 30509 - DNA, 23 bp, Homo sapiens
tctgaatagagtctgaagagtct

SEQ ID NO: 30510 - DNA, 16 bp, Homo sapiens
tttaagaccgaagact

SEQ ID NO: 30511 - DNA, 20 bp, Homo sapiens
accgaagactgtgcgctaat

SEQ ID NO: 30512 - DNA, 21 bp, Homo sapiens
accgaagactgtgcgctaatc

SEQ ID NO: 30513 - DNA, 20 bp, Homo sapiens
attagtgcatagtctttggt

SEQ ID NO: 30514 - DNA, 21 bp, Homo sapiens
attagtgcatagtctttggtc

SEQ ID NO: 30515 - DNA, 22 bp, Homo sapiens
attagtgcatagtctttggtct

SEQ ID NO: 30516 - DNA, 19 bp, Homo sapiens
ttagtgcatagtctttggt

SEQ ID NO: 30517 - DNA, 20 bp, Homo sapiens
ttagtgcatagtctttggtc

SEQ ID NO: 30518 - DNA, 23 bp, Homo sapiens
ttagtgcatagtctttggtctca

SEQ ID NO: 30519 - DNA, 26 bp, Homo sapiens
ttctctttctttagccttgtgtagat

SEQ ID NO: 30520 - DNA, 23 bp, Homo sapiens
ttctctttctttagccttgtgta

SEQ ID NO: 30521 - DNA, 21 bp, Homo sapiens
tctctttctttagccttgtgt

SEQ ID NO: 30522 - DNA, 23 bp, Homo sapiens
gttctctttctttagccttgtgt

SEQ ID NO: 30523 - DNA, 21 bp, Homo sapiens
ttctctttctttagccttgtg

SEQ ID NO: 30524 - DNA, 22 bp, Homo sapiens
gttctctttctttagccttgtg

SEQ ID NO: 30525 - DNA, 21 bp, Homo sapiens
gttctctttctttagccttgt

SEQ ID NO: 30526 - DNA, 22 bp, Homo sapiens
tgttctctttctttagccttgt

SEQ ID NO: 30527 - DNA, 21 bp, Homo sapiens
tgttctctttctttagccttg

SEQ ID NO: 30528 - DNA, 23 bp, Homo sapiens
gctgttctctttctttagccttg

SEQ ID NO: 30529 - DNA, 24 bp, Homo sapiens
aaggccaaaggaagagaacagata

SEQ ID NO: 30530 - DNA, 25 bp, Homo sapiens
caaggccaaaggaagagaacagata

SEQ ID NO: 30531 - DNA, 21 bp, Homo sapiens
aggccaaaggaagagaacaga

SEQ ID NO: 30532 - DNA, 22 bp, Homo sapiens
aaggccaaaggaagagaacaga

SEQ ID NO: 30533 - DNA, 23 bp, Homo sapiens
caaggccaaaggaagagaacaga

SEQ ID NO: 30534 - DNA, 20 bp, Homo sapiens
aggccaaaggaagagaacag

SEQ ID NO: 30535 - DNA, 21 bp, Homo sapiens
aaggccaaaggaagagaacag

SEQ ID NO: 30536 - DNA, 19 bp, Homo sapiens
aggccaaaggaagagaaca

SEQ ID NO: 30537 - DNA, 21 bp, Homo sapiens
caaggccaaaggaagagaaca

SEQ ID NO: 30538 - DNA, 20 bp, Homo sapiens
caaggccaaaggaagagaac

SEQ ID NO: 30539 - DNA, 19 bp, Homo sapiens
caaggccaaaggaagagaa

SEQ ID NO: 30540 - DNA, 18 bp, Homo sapiens
caaggccaaaggaagaga

SEQ ID NO: 30541 - DNA, 27 bp, Homo sapiens
agaaaaccgtctagttacagttgtaag

SEQ ID NO: 30542 - DNA, 23 bp, Homo sapiens
aaaaccgtctagttacagttgta

SEQ ID NO: 30543 - DNA, 18 bp, Homo sapiens
ccgtctagttacagttgt

SEQ ID NO: 30544 - DNA, 21 bp, Homo sapiens
aaaccgtctagttacagttgt

SEQ ID NO: 30545 - DNA, 21 bp, Homo sapiens
aaaaccgtctagttacagttg

SEQ ID NO: 30546 - DNA, 19 bp, Homo sapiens
aaaccgtctagttacagtt

SEQ ID NO: 30547 - DNA, 20 bp, Homo sapiens
aaaaccgtctagttacagtt

SEQ ID NO: 30548 - DNA, 22 bp, Homo sapiens
agaaaaccgtctagttacagtt

SEQ ID NO: 30549 - DNA, 19 bp, Homo sapiens
aaaaccgtctagttacagt

SEQ ID NO: 30550 - DNA, 21 bp, Homo sapiens
agaaaaccgtctagttacagt

SEQ ID NO: 30551 - DNA, 18 bp, Homo sapiens
agtcagttttctgtcctg

SEQ ID NO: 30552 - DNA, 26 bp, Homo sapiens
ctgtaattagtcagttttctgtcctg

SEQ ID NO: 30553 - DNA, 23 bp, Homo sapiens
ctgtaattagtcagttttctgtc

SEQ ID NO: 30554 - DNA, 22 bp, Homo sapiens
ctgtaattagtcagttttctgt

SEQ ID NO: 30555 - DNA, 23 bp, Homo sapiens
gctgtaattagtcagttttctgt

SEQ ID NO: 30556 - DNA, 21 bp, Homo sapiens
ctgtaattagtcagttttctg

SEQ ID NO: 30557 - DNA, 23 bp, Homo sapiens
agctgtaattagtcagttttctg

SEQ ID NO: 30558 - DNA, 20 bp, Homo sapiens
ctgtaattagtcagttttct

SEQ ID NO: 30559 - DNA, 21 bp, Homo sapiens
gctgtaattagtcagttttct

SEQ ID NO: 30560 - DNA, 21 bp, Homo sapiens
agctgtaattagtcagttttc

SEQ ID NO: 30561 - DNA, 20 bp, Homo sapiens
agctgtaattagtcagtttt

SEQ ID NO: 30562 - DNA, 18 bp, Homo sapiens
agctgtaattagtcagtt

SEQ ID NO: 30563 - DNA, 16 bp, Homo sapiens
agctgtaattagtcag

SEQ ID NO: 30564 - DNA, 22 bp, Homo sapiens
ctggcaaggagacgggaacatg

SEQ ID NO: 30565 - DNA, 23 bp, Homo sapiens
ctggcaaggagacgggaacatgg

SEQ ID NO: 30566 - DNA, 24 bp, Homo sapiens
ctggcaaggagacgggaacatgga

SEQ ID NO: 30567 - DNA, 22 bp, Homo sapiens
tggcaaggagacgggaacatgg

SEQ ID NO: 30568 - DNA, 21 bp, Homo sapiens
caaggagacgggaacatggag

SEQ ID NO: 30569 - DNA, 23 bp, Homo sapiens
caaggagacgggaacatggagcc

SEQ ID NO: 30570 - DNA, 25 bp, Homo sapiens
caaggagacgggaacatggagccgc

SEQ ID NO: 30571 - DNA, 18 bp, Homo sapiens
gagacgggaacatggagc

SEQ ID NO: 30572 - DNA, 20 bp, Homo sapiens
gcactggacttggagccaga

SEQ ID NO: 30573 - DNA, 23 bp, Homo sapiens
gcactggacttggagccagaagt

SEQ ID NO: 30574 - DNA, 21 bp, Homo sapiens
actggacttggagccagaagt

SEQ ID NO: 30575 - DNA, 22 bp, Homo sapiens
actggacttggagccagaagtc

SEQ ID NO: 30576 - DNA, 23 bp, Homo sapiens
actggacttggagccagaagtct

SEQ ID NO: 30577 - DNA, 24 bp, Homo sapiens
actggacttggagccagaagtctt

SEQ ID NO: 30578 - DNA, 25 bp, Homo sapiens
actggacttggagccagaagtcttg

SEQ ID NO: 30579 - DNA, 21 bp, Homo sapiens
ctggacttggagccagaagtc

SEQ ID NO: 30580 - DNA, 26 bp, Homo sapiens
tacctgggagactgaggttggaagat

SEQ ID NO: 30581 - DNA, 24 bp, Homo sapiens
tacctgggagactgaggttggaag

SEQ ID NO: 30582 - DNA, 21 bp, Homo sapiens
cctgggagactgaggttggaa

SEQ ID NO: 30583 - DNA, 23 bp, Homo sapiens
tacctgggagactgaggttggaa

SEQ ID NO: 30584 - DNA, 24 bp, Homo sapiens
ctacctgggagactgaggttggaa

SEQ ID NO: 30585 - DNA, 21 bp, Homo sapiens
acctgggagactgaggttgga

SEQ ID NO: 30586 - DNA, 21 bp, Homo sapiens
tacctgggagactgaggttgg

SEQ ID NO: 30587 - DNA, 22 bp, Homo sapiens
ctacctgggagactgaggttgg

SEQ ID NO: 30588 - DNA, 21 bp, Homo sapiens
ctacctgggagactgaggttg

SEQ ID NO: 30589 - DNA, 17 bp, Homo sapiens
aattgttctttggtctt

SEQ ID NO: 30590 - DNA, 21 bp, Homo sapiens
aattgttctttggtctttcag

SEQ ID NO: 30591 - DNA, 22 bp, Homo sapiens
aattgttctttggtctttcagc

SEQ ID NO: 30592 - DNA, 23 bp, Homo sapiens
aattgttctttggtctttcagcc

SEQ ID NO: 30593 - DNA, 20 bp, Homo sapiens
attgttctttggtctttcag

SEQ ID NO: 30594 - DNA, 21 bp, Homo sapiens
attgttctttggtctttcagc

SEQ ID NO: 30595 - DNA, 22 bp, Homo sapiens
attgttctttggtctttcagcc

SEQ ID NO: 30596 - DNA, 23 bp, Homo sapiens
attgttctttggtctttcagcca

SEQ ID NO: 30597 - DNA, 24 bp, Homo sapiens
attgttctttggtctttcagccat

SEQ ID NO: 30598 - DNA, 25 bp, Homo sapiens
attgttctttggtctttcagccatg

SEQ ID NO: 30599 - DNA, 19 bp, Homo sapiens
ttgttctttggtctttcag

SEQ ID NO: 30600 - DNA, 20 bp, Homo sapiens
ttgttctttggtctttcagc

SEQ ID NO: 30601 - DNA, 21 bp, Homo sapiens
ttgttctttggtctttcagcc

SEQ ID NO: 30602 - DNA, 23 bp, Homo sapiens
ttgttctttggtctttcagccat

SEQ ID NO: 30603 - DNA, 24 bp, Homo sapiens
ttgttctttggtctttcagccatg

SEQ ID NO: 30604 - DNA, 25 bp, Homo sapiens
ttgttctttggtctttcagccatga

SEQ ID NO: 30605 - DNA, 22 bp, Homo sapiens
tgttctttggtctttcagccat

SEQ ID NO: 30606 - DNA, 23 bp, Homo sapiens
tgttctttggtctttcagccatg

SEQ ID NO: 30607 - DNA, 18 bp, Homo sapiens
tctgtgagaccaaagaac

SEQ ID NO: 30608 - DNA, 19 bp, Homo sapiens
tctgtgagaccaaagaact

SEQ ID NO: 30609 - DNA, 20 bp, Homo sapiens
tctgtgagaccaaagaacta

SEQ ID NO: 30610 - DNA, 21 bp, Homo sapiens
tctgtgagaccaaagaactac

SEQ ID NO: 30611 - DNA, 23 bp, Homo sapiens
tctgtgagaccaaagaactactt

SEQ ID NO: 30612 - DNA, 24 bp, Homo sapiens
tctgtgagaccaaagaactacttt

SEQ ID NO: 30613 - DNA, 27 bp, Homo sapiens
tctgtgagaccaaagaactactttgct

SEQ ID NO: 30614 - DNA, 28 bp, Homo sapiens
tctgtgagaccaaagaactactttgctt

SEQ ID NO: 30615 - DNA, 19 bp, Homo sapiens
gtgagaccaaagaactact

SEQ ID NO: 30616 - DNA, 27 bp, Homo sapiens
gaagaggaagaaatggctggttctcag

SEQ ID NO: 30617 - DNA, 28 bp, Homo sapiens
agaagaggaagaaatggctggttctcag

SEQ ID NO: 30618 - DNA, 26 bp, Homo sapiens
gaagaggaagaaatggctggttctca

SEQ ID NO: 30619 - DNA, 27 bp, Homo sapiens
agaagaggaagaaatggctggttctca

SEQ ID NO: 30620 - DNA, 25 bp, Homo sapiens
agaagaggaagaaatggctggttct

SEQ ID NO: 30621 - DNA, 21 bp, Homo sapiens
ggaagaagaggaagaaatggc

SEQ ID NO: 30622 - DNA, 18 bp, Homo sapiens
aggaagaagaggaagaaa

SEQ ID NO: 30623 - DNA, 20 bp, Homo sapiens
tcaaaatgtagaggaagacc

SEQ ID NO: 30624 - DNA, 22 bp, Homo sapiens
caaaatgtagaggaagacccca

SEQ ID NO: 30625 - DNA, 22 bp, Homo sapiens
aatgtagaggaagaccccagaa

SEQ ID NO: 30626 - DNA, 21 bp, Homo sapiens
atgtagaggaagaccccagaa

SEQ ID NO: 30627 - DNA, 22 bp, Homo sapiens
tgtagaggaagaccccagaagg

SEQ ID NO: 30628 - DNA, 23 bp, Homo sapiens
tgtagaggaagaccccagaagga

SEQ ID NO: 30629 - DNA, 18 bp, Homo sapiens
gtagaggaagaccccaga

SEQ ID NO: 30630 - DNA, 25 bp, Homo sapiens
cagactgtggctgaccagaggtaac

SEQ ID NO: 30631 - DNA, 24 bp, Homo sapiens
cagactgtggctgaccagaggtaa

SEQ ID NO: 30632 - DNA, 23 bp, Homo sapiens
ccagactgtggctgaccagaggt

SEQ ID NO: 30633 - DNA, 21 bp, Homo sapiens
cagactgtggctgaccagagg

SEQ ID NO: 30634 - DNA, 21 bp, Homo sapiens
ccagactgtggctgaccagag

SEQ ID NO: 30635 - DNA, 23 bp, Homo sapiens
ttccagactgtggctgaccagag

SEQ ID NO: 30636 - DNA, 16 bp, Homo sapiens
attggaataggggata

SEQ ID NO: 30637 - DNA, 19 bp, Homo sapiens
attggaataggggatatct

SEQ ID NO: 30638 - DNA, 21 bp, Homo sapiens
attggaataggggatatctca

SEQ ID NO: 30639 - DNA, 22 bp, Homo sapiens
attggaataggggatatctcag

SEQ ID NO: 30640 - DNA, 23 bp, Homo sapiens
attggaataggggatatctcagc

SEQ ID NO: 30641 - DNA, 24 bp, Homo sapiens
attggaataggggatatctcagca

SEQ ID NO: 30642 - DNA, 26 bp, Homo sapiens
attggaataggggatatctcagcatg

SEQ ID NO: 30643 - DNA, 18 bp, Homo sapiens
ttggaataggggatatct

SEQ ID NO: 30644 - DNA, 19 bp, Homo sapiens
ttggaataggggatatctc

SEQ ID NO: 30645 - DNA, 20 bp, Homo sapiens
ttggaataggggatatctca

SEQ ID NO: 30646 - DNA, 21 bp, Homo sapiens
ttggaataggggatatctcag

SEQ ID NO: 30647 - DNA, 23 bp, Homo sapiens
ttggaataggggatatctcagca

SEQ ID NO: 30648 - DNA, 24 bp, Homo sapiens
ttggaataggggatatctcagcat

SEQ ID NO: 30649 - DNA, 25 bp, Homo sapiens
ttggaataggggatatctcagcatg

SEQ ID NO: 30650 - DNA, 22 bp, Homo sapiens
tggaataggggatatctcagca

SEQ ID NO: 30651 - DNA, 22 bp, Homo sapiens
ctgacttctacctcttccaaag

SEQ ID NO: 30652 - DNA, 22 bp, Homo sapiens
tgacttctacctcttccaaagg

SEQ ID NO: 30653 - DNA, 23 bp, Homo sapiens
tgacttctacctcttccaaaggg

SEQ ID NO: 30654 - DNA, 24 bp, Homo sapiens
tgacttctacctcttccaaaggga

SEQ ID NO: 30655 - DNA, 21 bp, Homo sapiens
gacttctacctcttccaaagg

SEQ ID NO: 30656 - DNA, 28 bp, Homo sapiens
tggccctgactgaagaccagcagttgta

SEQ ID NO: 30657 - DNA, 27 bp, Homo sapiens
tggccctgactgaagaccagcagttgt

SEQ ID NO: 30658 - DNA, 28 bp, Homo sapiens
gtggccctgactgaagaccagcagttgt

SEQ ID NO: 30659 - DNA, 26 bp, Homo sapiens
tggccctgactgaagaccagcagttg

SEQ ID NO: 30660 - DNA, 27 bp, Homo sapiens
gtggccctgactgaagaccagcagttg

SEQ ID NO: 30661 - DNA, 26 bp, Homo sapiens
gtggccctgactgaagaccagcagtt

SEQ ID NO: 30662 - DNA, 25 bp, Homo sapiens
gtggccctgactgaagaccagcagt

SEQ ID NO: 30663 - DNA, 24 bp, Homo sapiens
gtggccctgactgaagaccagcag

SEQ ID NO: 30664 - DNA, 22 bp, Homo sapiens
tggccctgactgaagaccagca

SEQ ID NO: 30665 - DNA, 23 bp, Homo sapiens
gtggccctgactgaagaccagca

SEQ ID NO: 30666 - DNA, 21 bp, Homo sapiens
tggccctgactgaagaccagc

SEQ ID NO: 30667 - DNA, 22 bp, Homo sapiens
gtggccctgactgaagaccagc

SEQ ID NO: 30668 - DNA, 21 bp, Homo sapiens
gtggccctgactgaagaccag

SEQ ID NO: 30669 - DNA, 20 bp, Homo sapiens
gtggccctgactgaagacca

SEQ ID NO: 30670 - DNA, 18 bp, Homo sapiens
tggccctgactgaagacc

SEQ ID NO: 30671 - DNA, 19 bp, Homo sapiens
gtggccctgactgaagacc

SEQ ID NO: 30672 - DNA, 18 bp, Homo sapiens
gtggccctgactgaagac

SEQ ID NO: 30673 - DNA, 18 bp, Homo sapiens
gcgggcttcgcgggcgaa

SEQ ID NO: 30674 - DNA, 19 bp, Homo sapiens
gcgggcttcgcgggcgaag

SEQ ID NO: 30675 - DNA, 22 bp, Homo sapiens
gcgggcttcgcgggcgaaggca

SEQ ID NO: 30676 - DNA, 22 bp, Homo sapiens
gggcttcgcgggcgaaggcaaa

SEQ ID NO: 30677 - DNA, 26 bp, Homo sapiens
cttcgcgggcgaaggcaaagtcgatt

SEQ ID NO: 30678 - DNA, 19 bp, Homo sapiens
ttcgcgggcgaaggcaaag

SEQ ID NO: 30679 - DNA, 20 bp, Homo sapiens
ttcgcgggcgaaggcaaagt

SEQ ID NO: 30680 - DNA, 22 bp, Homo sapiens
ttcgcgggcgaaggcaaagtcg

SEQ ID NO: 30681 - DNA, 23 bp, Homo sapiens
ttcgcgggcgaaggcaaagtcga

SEQ ID NO: 30682 - DNA, 25 bp, Homo sapiens
ttcgcgggcgaaggcaaagtcgatt

SEQ ID NO: 30683 - DNA, 18 bp, Homo sapiens
gggcgaaggcaaagtcga

SEQ ID NO: 30684 - DNA, 17 bp, Homo sapiens
cgaaggcaaagtcgatt

SEQ ID NO: 30685 - DNA, 21 bp, Homo sapiens
actttcctcactcccgtgaag

SEQ ID NO: 30686 - DNA, 20 bp, Homo sapiens
ctttcctcactcccgtgaag

SEQ ID NO: 30687 - DNA, 21 bp, Homo sapiens
ctttcctcactcccgtgaagt

SEQ ID NO: 30688 - DNA, 23 bp, Homo sapiens
tttcctcactcccgtgaagtcgg

SEQ ID NO: 30689 - DNA, 21 bp, Homo sapiens
ttcctcactcccgtgaagtcg

SEQ ID NO: 30690 - DNA, 22 bp, Homo sapiens
ttcctcactcccgtgaagtcgg

SEQ ID NO: 30691 - DNA, 23 bp, Homo sapiens
ttcctcactcccgtgaagtcggc

SEQ ID NO: 30692 - DNA, 19 bp, Homo sapiens
actcccgtgaagtcggcgg

SEQ ID NO: 30693 - DNA, 16 bp, Homo sapiens
cccgtgaagtcggcgg

SEQ ID NO: 30694 - DNA, 20 bp, Homo sapiens
gatgggtgtggtgtccacag

SEQ ID NO: 30695 - DNA, 21 bp, Homo sapiens
tgatgggtgtggtgtccacag

SEQ ID NO: 30696 - DNA, 22 bp, Homo sapiens
gtgatgggtgtggtgtccacag

SEQ ID NO: 30697 - DNA, 25 bp, Homo sapiens
tgggtgatgggtgtggtgtccacag

SEQ ID NO: 30698 - DNA, 26 bp, Homo sapiens
atgggtgatgggtgtggtgtccacag

SEQ ID NO: 30699 - DNA, 24 bp, Homo sapiens
tgggtgatgggtgtggtgtccaca

SEQ ID NO: 30700 - DNA, 25 bp, Homo sapiens
atgggtgatgggtgtggtgtccaca

SEQ ID NO: 30701 - DNA, 23 bp, Homo sapiens
atgggtgatgggtgtggtgtcca

SEQ ID NO: 30702 - DNA, 21 bp, Homo sapiens
tgggtgatgggtgtggtgtcc

SEQ ID NO: 30703 - DNA, 22 bp, Homo sapiens
atgggtgatgggtgtggtgtcc

SEQ ID NO: 30704 - DNA, 23 bp, Homo sapiens
tggccaccacacctaccccttgt

SEQ ID NO: 30705 - DNA, 25 bp, Homo sapiens
cttggccaccacacctaccccttgt

SEQ ID NO: 30706 - DNA, 22 bp, Homo sapiens
tggccaccacacctaccccttg

SEQ ID NO: 30707 - DNA, 23 bp, Homo sapiens
ttggccaccacacctaccccttg

SEQ ID NO: 30708 - DNA, 25 bp, Homo sapiens
ccttggccaccacacctaccccttg

SEQ ID NO: 30709 - DNA, 21 bp, Homo sapiens
tggccaccacacctacccctt

SEQ ID NO: 30710 - DNA, 23 bp, Homo sapiens
cttggccaccacacctacccctt

SEQ ID NO: 30711 - DNA, 24 bp, Homo sapiens
ccttggccaccacacctacccctt

SEQ ID NO: 30712 - DNA, 20 bp, Homo sapiens
tggccaccacacctacccct

SEQ ID NO: 30713 - DNA, 21 bp, Homo sapiens
ttggccaccacacctacccct

SEQ ID NO: 30714 - DNA, 22 bp, Homo sapiens
cttggccaccacacctacccct

SEQ ID NO: 30715 - DNA, 21 bp, Homo sapiens
tctggagatttgtgcagcttg

SEQ ID NO: 30716 - DNA, 24 bp, Homo sapiens
ggtggtctggagatttgtgcagct

SEQ ID NO: 30717 - DNA, 22 bp, Homo sapiens
gtggtctggagatttgtgcagc

SEQ ID NO: 30718 - DNA, 23 bp, Homo sapiens
ggtggtctggagatttgtgcagc

SEQ ID NO: 30719 - DNA, 24 bp, Homo sapiens
gggtggtctggagatttgtgcagc

SEQ ID NO: 30720 - DNA, 25 bp, Homo sapiens
tgggtggtctggagatttgtgcagc

SEQ ID NO: 30721 - DNA, 26 bp, Homo sapiens
ctgggtggtctggagatttgtgcagc

SEQ ID NO: 30722 - DNA, 21 bp, Homo sapiens
gtggtctggagatttgtgcag

SEQ ID NO: 30723 - DNA, 20 bp, Homo sapiens
gtggtctggagatttgtgca

SEQ ID NO: 30724 - DNA, 21 bp, Homo sapiens
ggtggtctggagatttgtgca

SEQ ID NO: 30725 - DNA, 23 bp, Homo sapiens
tgggtggtctggagatttgtgca

SEQ ID NO: 30726 - DNA, 17 bp, Homo sapiens
ggtctggagatttgtgc

SEQ ID NO: 30727 - DNA, 24 bp, Homo sapiens
tctgggtggtctggagatttgtgc

SEQ ID NO: 30728 - DNA, 21 bp, Homo sapiens
tgggtggtctggagatttgtg

SEQ ID NO: 30729 - DNA, 22 bp, Homo sapiens
ctgggtggtctggagatttgtg

SEQ ID NO: 30730 - DNA, 23 bp, Homo sapiens
tctgggtggtctggagatttgtg

SEQ ID NO: 30731 - DNA, 23 bp, Homo sapiens
gttctgggtggtctggagatttg

SEQ ID NO: 30732 - DNA, 20 bp, Homo sapiens
tctgggtggtctggagattt

SEQ ID NO: 30733 - DNA, 19 bp, Homo sapiens
tctgggtggtctggagatt

SEQ ID NO: 30734 - DNA, 24 bp, Homo sapiens
tctattccccactctccccaggga

SEQ ID NO: 30735 - DNA, 23 bp, Homo sapiens
tctattccccactctccccaggg

SEQ ID NO: 30736 - DNA, 21 bp, Homo sapiens
ctattccccactctccccagg

SEQ ID NO: 30737 - DNA, 22 bp, Homo sapiens
tctattccccactctccccagg

SEQ ID NO: 30738 - DNA, 23 bp, Homo sapiens
ctctattccccactctccccagg

SEQ ID NO: 30739 - DNA, 22 bp, Homo sapiens
ctctattccccactctccccag

SEQ ID NO: 30740 - DNA, 27 bp, Homo sapiens
tgggagagcagggtattgtggaagctc

SEQ ID NO: 30741 - DNA, 25 bp, Homo sapiens
tgggagagcagggtattgtggaagc

SEQ ID NO: 30742 - DNA, 24 bp, Homo sapiens
tgggagagcagggtattgtggaag

SEQ ID NO: 30743 - DNA, 23 bp, Homo sapiens
tgggagagcagggtattgtggaa

SEQ ID NO: 30744 - DNA, 17 bp, Homo sapiens
gagcagggtattgtgga

SEQ ID NO: 30745 - DNA, 26 bp, Homo sapiens
caggtgggagagcagggtattgtgga

SEQ ID NO: 30746 - DNA, 21 bp, Homo sapiens
tgggagagcagggtattgtgg

SEQ ID NO: 30747 - DNA, 20 bp, Homo sapiens
ttagggatgggaggccagga

SEQ ID NO: 30748 - DNA, 23 bp, Homo sapiens
ttagggatgggaggccaggatga

SEQ ID NO: 30749 - DNA, 21 bp, Homo sapiens
tagggatgggaggccaggatg

SEQ ID NO: 30750 - DNA, 23 bp, Homo sapiens
tagggatgggaggccaggatgaa

SEQ ID NO: 30751 - DNA, 24 bp, Homo sapiens
tagggatgggaggccaggatgaag

SEQ ID NO: 30752 - DNA, 23 bp, Homo sapiens
cccaacactggccttgctatccc

SEQ ID NO: 30753 - DNA, 20 bp, Homo sapiens
aacactggccttgctatccc

SEQ ID NO: 30754 - DNA, 21 bp, Homo sapiens
aacactggccttgctatcccc

SEQ ID NO: 30755 - DNA, 23 bp, Homo sapiens
aacactggccttgctatccccag

SEQ ID NO: 30756 - DNA, 24 bp, Homo sapiens
aacactggccttgctatccccagg

SEQ ID NO: 30757 - DNA, 25 bp, Homo sapiens
aacactggccttgctatccccaggg

SEQ ID NO: 30758 - DNA, 17 bp, Homo sapiens
tgttgggattcagcagg

SEQ ID NO: 30759 - DNA, 19 bp, Homo sapiens
tgttgggattcagcaggac

SEQ ID NO: 30760 - DNA, 20 bp, Homo sapiens
tgttgggattcagcaggacc

SEQ ID NO: 30761 - DNA, 21 bp, Homo sapiens
tgttgggattcagcaggacca

SEQ ID NO: 30762 - DNA, 23 bp, Homo sapiens
tgttgggattcagcaggaccatt

SEQ ID NO: 30763 - DNA, 24 bp, Homo sapiens
tgttgggattcagcaggaccattc

SEQ ID NO: 30764 - DNA, 20 bp, Homo sapiens
ttgggattcagcaggaccat

SEQ ID NO: 30765 - DNA, 21 bp, Homo sapiens
ttgggattcagcaggaccatt

SEQ ID NO: 30766 - DNA, 22 bp, Homo sapiens
ttgggattcagcaggaccattc

SEQ ID NO: 30767 - DNA, 20 bp, Homo sapiens
tgggattcagcaggaccatt

SEQ ID NO: 30768 - DNA, 23 bp, Homo sapiens
tgggattcagcaggaccattcgt

SEQ ID NO: 30769 - DNA, 21 bp, Homo sapiens
gattcagcaggaccattcgtg

SEQ ID NO: 30770 - DNA, 22 bp, Homo sapiens
gattcagcaggaccattcgtgt

SEQ ID NO: 30771 - DNA, 21 bp, Homo sapiens
taggtagtttcatgttgttgg

SEQ ID NO: 30772 - DNA, 23 bp, Homo sapiens
taggtagtttcatgttgttggga

SEQ ID NO: 30773 - DNA, 24 bp, Homo sapiens
taggtagtttcatgttgttgggat

SEQ ID NO: 30774 - DNA, 25 bp, Homo sapiens
taggtagtttcatgttgttgggatt

SEQ ID NO: 30775 - DNA, 27 bp, Homo sapiens
taggtagtttcatgttgttgggattga

SEQ ID NO: 30776 - DNA, 22 bp, Homo sapiens
aggtagtttcatgttgttggga

SEQ ID NO: 30777 - DNA, 24 bp, Homo sapiens
aggtagtttcatgttgttgggatt

SEQ ID NO: 30778 - DNA, 21 bp, Homo sapiens
ggtagtttcatgttgttggga

SEQ ID NO: 30779 - DNA, 22 bp, Homo sapiens
ggtagtttcatgttgttgggat

SEQ ID NO: 30780 - DNA, 20 bp, Homo sapiens
gtagtttcatgttgttggga

SEQ ID NO: 30781 - DNA, 21 bp, Homo sapiens
gtagtttcatgttgttgggat

SEQ ID NO: 30782 - DNA, 22 bp, Homo sapiens
gtagtttcatgttgttgggatt

SEQ ID NO: 30783 - DNA, 23 bp, Homo sapiens
gtagtttcatgttgttgggattg

SEQ ID NO: 30784 - DNA, 24 bp, Homo sapiens
gtagtttcatgttgttgggattga

SEQ ID NO: 30785 - DNA, 25 bp, Homo sapiens
gtagtttcatgttgttgggattgag

SEQ ID NO: 30786 - DNA, 24 bp, Homo sapiens
actcggcaacaagaaactgcctga

SEQ ID NO: 30787 - DNA, 18 bp, Homo sapiens
tcggcaacaagaaactgc

SEQ ID NO: 30788 - DNA, 19 bp, Homo sapiens
tcggcaacaagaaactgcc

SEQ ID NO: 30789 - DNA, 20 bp, Homo sapiens
tcggcaacaagaaactgcct

SEQ ID NO: 30790 - DNA, 21 bp, Homo sapiens
tcggcaacaagaaactgcctg

SEQ ID NO: 30791 - DNA, 22 bp, Homo sapiens
tcggcaacaagaaactgcctga

SEQ ID NO: 30792 - DNA, 23 bp, Homo sapiens
tcggcaacaagaaactgcctgag

SEQ ID NO: 30793 - DNA, 24 bp, Homo sapiens
tcggcaacaagaaactgcctgagt

SEQ ID NO: 30794 - DNA, 21 bp, Homo sapiens
cggcaacaagaaactgcctga

SEQ ID NO: 30795 - DNA, 23 bp, Homo sapiens
cggcaacaagaaactgcctgagt

SEQ ID NO: 30796 - DNA, 17 bp, Homo sapiens
gggggtccccggtgctc

SEQ ID NO: 30797 - DNA, 18 bp, Homo sapiens
gggggtccccggtgctcg

SEQ ID NO: 30798 - DNA, 19 bp, Homo sapiens
gggggtccccggtgctcgg

SEQ ID NO: 30799 - DNA, 20 bp, Homo sapiens
gggggtccccggtgctcgga

SEQ ID NO: 30800 - DNA, 21 bp, Homo sapiens
gggggtccccggtgctcggat

SEQ ID NO: 30801 - DNA, 23 bp, Homo sapiens
gggggtccccggtgctcggatct

SEQ ID NO: 30802 - DNA, 24 bp, Homo sapiens
gggggtccccggtgctcggatctc

SEQ ID NO: 30803 - DNA, 25 bp, Homo sapiens
gggggtccccggtgctcggatctcg

SEQ ID NO: 30804 - DNA, 27 bp, Homo sapiens
gggggtccccggtgctcggatctcgag

SEQ ID NO: 30805 - DNA, 21 bp, Homo sapiens
ggggtccccggtgctcggatc

SEQ ID NO: 30806 - DNA, 23 bp, Homo sapiens
ggggtccccggtgctcggatctc

SEQ ID NO: 30807 - DNA, 18 bp, Homo sapiens
tccgagcctgggtctccc

SEQ ID NO: 30808 - DNA, 19 bp, Homo sapiens
tccgagcctgggtctccct

SEQ ID NO: 30809 - DNA, 20 bp, Homo sapiens
tccgagcctgggtctccctc

SEQ ID NO: 30810 - DNA, 21 bp, Homo sapiens
tccgagcctgggtctccctct

SEQ ID NO: 30811 - DNA, 23 bp, Homo sapiens
tccgagcctgggtctccctcttc

SEQ ID NO: 30812 - DNA, 24 bp, Homo sapiens
tccgagcctgggtctccctcttcc

SEQ ID NO: 30813 - DNA, 26 bp, Homo sapiens
tccgagcctgggtctccctcttcccc

SEQ ID NO: 30814 - DNA, 25 bp, Homo sapiens
ggttctgtggagtcctggggaatgg

SEQ ID NO: 30815 - DNA, 24 bp, Homo sapiens
ggttctgtggagtcctggggaatg

SEQ ID NO: 30816 - DNA, 22 bp, Homo sapiens
ggttctgtggagtcctggggaa

SEQ ID NO: 30817 - DNA, 17 bp, Homo sapiens
ggttctgtggagtcctg

SEQ ID NO: 30818 - DNA, 16 bp, Homo sapiens
ggttctgtggagtcct

SEQ ID NO: 30819 - DNA, 17 bp, Homo sapiens
gaagttctgttatacac

SEQ ID NO: 30820 - DNA, 18 bp, Homo sapiens
gaagttctgttatacact

SEQ ID NO: 30821 - DNA, 19 bp, Homo sapiens
gaagttctgttatacactc

SEQ ID NO: 30822 - DNA, 20 bp, Homo sapiens
gaagttctgttatacactca

SEQ ID NO: 30823 - DNA, 21 bp, Homo sapiens
gaagttctgttatacactcag

SEQ ID NO: 30824 - DNA, 22 bp, Homo sapiens
gaagttctgttatacactcagg

SEQ ID NO: 30825 - DNA, 23 bp, Homo sapiens
gaagttctgttatacactcaggc

SEQ ID NO: 30826 - DNA, 24 bp, Homo sapiens
gaagttctgttatacactcaggct

SEQ ID NO: 30827 - DNA, 25 bp, Homo sapiens
gaagttctgttatacactcaggctg

SEQ ID NO: 30828 - DNA, 26 bp, Homo sapiens
gaagttctgttatacactcaggctgt

SEQ ID NO: 30829 - DNA, 23 bp, Homo sapiens
aagttctgttatacactcaggct

SEQ ID NO: 30830 - DNA, 20 bp, Homo sapiens
agttctgttatacactcagg

SEQ ID NO: 30831 - DNA, 19 bp, Homo sapiens
tcagtgcatcacagaactt

SEQ ID NO: 30832 - DNA, 20 bp, Homo sapiens
tcagtgcatcacagaacttt

SEQ ID NO: 30833 - DNA, 21 bp, Homo sapiens
tcagtgcatcacagaactttg

SEQ ID NO: 30834 - DNA, 23 bp, Homo sapiens
tcagtgcatcacagaactttgtc

SEQ ID NO: 30835 - DNA, 24 bp, Homo sapiens
tcagtgcatcacagaactttgtct

SEQ ID NO: 30836 - DNA, 25 bp, Homo sapiens
tcagtgcatcacagaactttgtctc

SEQ ID NO: 30837 - DNA, 26 bp, Homo sapiens
tcagtgcatcacagaactttgtctcg

SEQ ID NO: 30838 - DNA, 18 bp, Homo sapiens
gtgggcgggggcaggtgt

SEQ ID NO: 30839 - DNA, 19 bp, Homo sapiens
gtgggcgggggcaggtgtg

SEQ ID NO: 30840 - DNA, 20 bp, Homo sapiens
gtgggcgggggcaggtgtgt

SEQ ID NO: 30841 - DNA, 22 bp, Homo sapiens
gtgggcgggggcaggtgtgtgg

SEQ ID NO: 30842 - DNA, 23 bp, Homo sapiens
gtgggcgggggcaggtgtgtggt

SEQ ID NO: 30843 - DNA, 24 bp, Homo sapiens
gtgggcgggggcaggtgtgtggtg

SEQ ID NO: 30844 - DNA, 27 bp, Homo sapiens
gtgggcgggggcaggtgtgtggtgggt

SEQ ID NO: 30845 - DNA, 19 bp, Homo sapiens
tgggcgggggcaggtgtgt

SEQ ID NO: 30846 - DNA, 21 bp, Homo sapiens
tgggcgggggcaggtgtgtgg

SEQ ID NO: 30847 - DNA, 24 bp, Homo sapiens
tgggcgggggcaggtgtgtggtgg

SEQ ID NO: 30848 - DNA, 26 bp, Homo sapiens
tgggcgggggcaggtgtgtggtgggt

SEQ ID NO: 30849 - DNA, 21 bp, Homo sapiens
cctcacacctgcctcgccccc

SEQ ID NO: 30850 - DNA, 22 bp, Homo sapiens
cctcacacctgcctcgcccccc

SEQ ID NO: 30851 - DNA, 24 bp, Homo sapiens
cctcacacctgcctcgccccccag

SEQ ID NO: 30852 - DNA, 22 bp, Homo sapiens
ctcacacctgcctcgcccccca

SEQ ID NO: 30853 - DNA, 17 bp, Homo sapiens
tcacacctgcctcgccc

SEQ ID NO: 30854 - DNA, 19 bp, Homo sapiens
tcacacctgcctcgccccc

SEQ ID NO: 30855 - DNA, 21 bp, Homo sapiens
tcacacctgcctcgcccccca

SEQ ID NO: 30856 - DNA, 22 bp, Homo sapiens
tcacacctgcctcgccccccag

SEQ ID NO: 30857 - DNA, 23 bp, Homo sapiens
tcacacctgcctcgccccccagg

SEQ ID NO: 30858 - DNA, 24 bp, Homo sapiens
tcacacctgcctcgccccccaggt

SEQ ID NO: 30859 - DNA, 22 bp, Homo sapiens
cacacctgcctcgccccccagg

SEQ ID NO: 30860 - DNA, 18 bp, Homo sapiens
acacctgcctcgcccccc

SEQ ID NO: 30861 - DNA, 21 bp, Homo sapiens
gtgggctagagaggggaagga

SEQ ID NO: 30862 - DNA, 22 bp, Homo sapiens
gtgggctagagaggggaaggat

SEQ ID NO: 30863 - DNA, 24 bp, Homo sapiens
gtgggctagagaggggaaggatgt

SEQ ID NO: 30864 - DNA, 21 bp, Homo sapiens
tgggctagagaggggaaggat

SEQ ID NO: 30865 - DNA, 23 bp, Homo sapiens
tgggctagagaggggaaggatgt

SEQ ID NO: 30866 - DNA, 22 bp, Homo sapiens
gctagagaggggaaggatgtga

SEQ ID NO: 30867 - DNA, 21 bp, Homo sapiens
tagagaggggaaggatgtgat

SEQ ID NO: 30868 - DNA, 22 bp, Homo sapiens
tagagaggggaaggatgtgatg

SEQ ID NO: 30869 - DNA, 24 bp, Homo sapiens
tagagaggggaaggatgtgatgtg

SEQ ID NO: 30870 - DNA, 25 bp, Homo sapiens
tagagaggggaaggatgtgatgtga

SEQ ID NO: 30871 - DNA, 22 bp, Homo sapiens
agagaggggaaggatgtgatgt

SEQ ID NO: 30872 - DNA, 24 bp, Homo sapiens
agagaggggaaggatgtgatgtga

SEQ ID NO: 30873 - DNA, 21 bp, Homo sapiens
gagaggggaaggatgtgatgt

SEQ ID NO: 30874 - DNA, 23 bp, Homo sapiens
gagaggggaaggatgtgatgtga

SEQ ID NO: 30875 - DNA, 26 bp, Homo sapiens
ttctcactcattctcctctgtccaga

SEQ ID NO: 30876 - DNA, 27 bp, Homo sapiens
ttctcactcattctcctctgtccagag

SEQ ID NO: 30877 - DNA, 24 bp, Homo sapiens
tctcactcattctcctctgtccag

SEQ ID NO: 30878 - DNA, 23 bp, Homo sapiens
ctcactcattctcctctgtccag

SEQ ID NO: 30879 - DNA, 24 bp, Homo sapiens
ctcactcattctcctctgtccaga

SEQ ID NO: 30880 - DNA, 25 bp, Homo sapiens
ctcactcattctcctctgtccagag

SEQ ID NO: 30881 - DNA, 22 bp, Homo sapiens
tcactcattctcctctgtccag

SEQ ID NO: 30882 - DNA, 23 bp, Homo sapiens
tcactcattctcctctgtccaga

SEQ ID NO: 30883 - DNA, 21 bp, Homo sapiens
actcattctcctctgtccaga

SEQ ID NO: 30884 - DNA, 22 bp, Homo sapiens
actcattctcctctgtccagag

SEQ ID NO: 30885 - DNA, 23 bp, Homo sapiens
actcattctcctctgtccagagt

SEQ ID NO: 30886 - DNA, 23 bp, Homo sapiens
gtcattggagggtttgagcagag

SEQ ID NO: 30887 - DNA, 22 bp, Homo sapiens
gtcattggagggtttgagcaga

SEQ ID NO: 30888 - DNA, 23 bp, Homo sapiens
agtcattggagggtttgagcaga

SEQ ID NO: 30889 - DNA, 24 bp, Homo sapiens
aagtcattggagggtttgagcaga

SEQ ID NO: 30890 - DNA, 21 bp, Homo sapiens
gtcattggagggtttgagcag

SEQ ID NO: 30891 - DNA, 23 bp, Homo sapiens
aagtcattggagggtttgagcag

SEQ ID NO: 30892 - DNA, 22 bp, Homo sapiens
aagtcattggagggtttgagca

SEQ ID NO: 30893 - DNA, 22 bp, Homo sapiens
aggaagtcattggagggtttga

SEQ ID NO: 30894 - DNA, 21 bp, Homo sapiens
acccttcagtgacttccatga

SEQ ID NO: 30895 - DNA, 23 bp, Homo sapiens
aaacccttcagtgacttccatga

SEQ ID NO: 30896 - DNA, 27 bp, Homo sapiens
actcaaaacccttcagtgacttccatg

SEQ ID NO: 30897 - DNA, 23 bp, Homo sapiens
caaaacccttcagtgacttccat

SEQ ID NO: 30898 - DNA, 26 bp, Homo sapiens
actcaaaacccttcagtgacttccat

SEQ ID NO: 30899 - DNA, 27 bp, Homo sapiens
cactcaaaacccttcagtgacttccat

SEQ ID NO: 30900 - DNA, 20 bp, Homo sapiens
aaacccttcagtgacttcca

SEQ ID NO: 30901 - DNA, 21 bp, Homo sapiens
aaaacccttcagtgacttcca

SEQ ID NO: 30902 - DNA, 22 bp, Homo sapiens
caaaacccttcagtgacttcca

SEQ ID NO: 30903 - DNA, 23 bp, Homo sapiens
tcaaaacccttcagtgacttcca

SEQ ID NO: 30904 - DNA, 24 bp, Homo sapiens
ctcaaaacccttcagtgacttcca

SEQ ID NO: 30905 - DNA, 25 bp, Homo sapiens
actcaaaacccttcagtgacttcca

SEQ ID NO: 30906 - DNA, 23 bp, Homo sapiens
cactcaaaacccttcagtgactt

SEQ ID NO: 30907 - DNA, 22 bp, Homo sapiens
cactcaaaacccttcagtgact

SEQ ID NO: 30908 - DNA, 23 bp, Homo sapiens
ccactcaaaacccttcagtgact

SEQ ID NO: 30909 - DNA, 21 bp, Homo sapiens
cactcaaaacccttcagtgac

SEQ ID NO: 30910 - DNA, 24 bp, Homo sapiens
tgacctttgcctctcccctcagga

SEQ ID NO: 30911 - DNA, 22 bp, Homo sapiens
gacctttgcctctcccctcagg

SEQ ID NO: 30912 - DNA, 23 bp, Homo sapiens
tgacctttgcctctcccctcagg

SEQ ID NO: 30913 - DNA, 21 bp, Homo sapiens
tgacctttgcctctcccctca

SEQ ID NO: 30914 - DNA, 24 bp, Homo sapiens
tttctgacctttgcctctcccctc

SEQ ID NO: 30915 - DNA, 19 bp, Homo sapiens
tgacctttgcctctcccct

SEQ ID NO: 30916 - DNA, 23 bp, Homo sapiens
gttgtgggtgggcagaagtctgt

SEQ ID NO: 30917 - DNA, 20 bp, Homo sapiens
ttgtgggtgggcagaagtct

SEQ ID NO: 30918 - DNA, 21 bp, Homo sapiens
gttgtgggtgggcagaagtct

SEQ ID NO: 30919 - DNA, 23 bp, Homo sapiens
ttgttgtgggtgggcagaagtct

SEQ ID NO: 30920 - DNA, 27 bp, Homo sapiens
cctattcttgattacttgtttctggag

SEQ ID NO: 30921 - DNA, 25 bp, Homo sapiens
cctattcttgattacttgtttctgg

SEQ ID NO: 30922 - DNA, 24 bp, Homo sapiens
cctattcttgattacttgtttctg

SEQ ID NO: 30923 - DNA, 23 bp, Homo sapiens
cctattcttgattacttgtttct

SEQ ID NO: 30924 - DNA, 25 bp, Homo sapiens
aggcctattcttgattacttgtttc

SEQ ID NO: 30925 - DNA, 21 bp, Homo sapiens
cctattcttgattacttgttt

SEQ ID NO: 30926 - DNA, 20 bp, Homo sapiens
cctattcttgattacttgtt

SEQ ID NO: 30927 - DNA, 21 bp, Homo sapiens
gcctattcttgattacttgtt

SEQ ID NO: 30928 - DNA, 23 bp, Homo sapiens
aggcctattcttgattacttgtt

SEQ ID NO: 30929 - DNA, 19 bp, Homo sapiens
cctattcttgattacttgt

SEQ ID NO: 30930 - DNA, 22 bp, Homo sapiens
aggcctattcttgattacttgt

SEQ ID NO: 30931 - DNA, 18 bp, Homo sapiens
cctattcttgattacttg

SEQ ID NO: 30932 - DNA, 21 bp, Homo sapiens
aggcctattcttgattacttg

SEQ ID NO: 30933 - DNA, 28 bp, Homo sapiens
ttcaagtaatccaggataggctgtttcc

SEQ ID NO: 30934 - DNA, 26 bp, Homo sapiens
tcaagtaatccaggataggctgtttc

SEQ ID NO: 30935 - DNA, 27 bp, Homo sapiens
ttcaagtaatccaggataggctgtttc

SEQ ID NO: 30936 - DNA, 26 bp, Homo sapiens
ttcaagtaatccaggataggctgttt

SEQ ID NO: 30937 - DNA, 25 bp, Homo sapiens
ttcaagtaatccaggataggctgtt

SEQ ID NO: 30938 - DNA, 24 bp, Homo sapiens
attcaagtaatccaggataggctg

SEQ ID NO: 30939 - DNA, 23 bp, Homo sapiens
attcaagtaatccaggataggct

SEQ ID NO: 30940 - DNA, 24 bp, Homo sapiens
gattcaagtaatccaggataggct

SEQ ID NO: 30941 - DNA, 25 bp, Homo sapiens
ggattcaagtaatccaggataggct

SEQ ID NO: 30942 - DNA, 22 bp, Homo sapiens
attcaagtaatccaggataggc

SEQ ID NO: 30943 - DNA, 21 bp, Homo sapiens
attcaagtaatccaggatagg

SEQ ID NO: 30944 - DNA, 19 bp, Homo sapiens
attcaagtaatccaggata

SEQ ID NO: 30945 - DNA, 17 bp, Homo sapiens
gagcaggtgggtgcggg

SEQ ID NO: 30946 - DNA, 19 bp, Homo sapiens
ctgagcaggtgggtgcggg

SEQ ID NO: 30947 - DNA, 22 bp, Homo sapiens
ggactgagcaggtgggtgcggg

SEQ ID NO: 30948 - DNA, 23 bp, Homo sapiens
cggactgagcaggtgggtgcggg

SEQ ID NO: 30949 - DNA, 25 bp, Homo sapiens
gctcggactgagcaggtgggtgcgg

SEQ ID NO: 30950 - DNA, 20 bp, Homo sapiens
ggactgagcaggtgggtgcg

SEQ ID NO: 30951 - DNA, 21 bp, Homo sapiens
cggactgagcaggtgggtgcg

SEQ ID NO: 30952 - DNA, 22 bp, Homo sapiens
ctcggactgagcaggtgggtgc

SEQ ID NO: 30953 - DNA, 23 bp, Homo sapiens
gctcggactgagcaggtgggtgc

SEQ ID NO: 30954 - DNA, 25 bp, Homo sapiens
cggctcggactgagcaggtgggtgc

SEQ ID NO: 30955 - DNA, 26 bp, Homo sapiens
gcggctcggactgagcaggtgggtgc

SEQ ID NO: 30956 - DNA, 19 bp, Homo sapiens
cggactgagcaggtgggtg

SEQ ID NO: 30957 - DNA, 20 bp, Homo sapiens
tcggactgagcaggtgggtg

SEQ ID NO: 30958 - DNA, 22 bp, Homo sapiens
cggctcggactgagcaggtggg

SEQ ID NO: 30959 - DNA, 24 bp, Homo sapiens
aggcggctcggactgagcaggtgg

SEQ ID NO: 30960 - DNA, 25 bp, Homo sapiens
caggcggctcggactgagcaggtgg

SEQ ID NO: 30961 - DNA, 18 bp, Homo sapiens
gctcggactgagcaggtg

SEQ ID NO: 30962 - DNA, 20 bp, Homo sapiens
cggctcggactgagcaggtg

SEQ ID NO: 30963 - DNA, 21 bp, Homo sapiens
gcggctcggactgagcaggtg

SEQ ID NO: 30964 - DNA, 22 bp, Homo sapiens
ggcggctcggactgagcaggtg

SEQ ID NO: 30965 - DNA, 23 bp, Homo sapiens
aggcggctcggactgagcaggtg

SEQ ID NO: 30966 - DNA, 24 bp, Homo sapiens
caggcggctcggactgagcaggtg

SEQ ID NO: 30967 - DNA, 18 bp, Homo sapiens
cggctcggactgagcagg

SEQ ID NO: 30968 - DNA, 20 bp, Homo sapiens
aggcggctcggactgagcag

SEQ ID NO: 30969 - DNA, 20 bp, Homo sapiens
caggcggctcggactgagca

SEQ ID NO: 30970 - DNA, 17 bp, Homo sapiens
ggcggctcggactgagc

SEQ ID NO: 30971 - DNA, 18 bp, Homo sapiens
aggcggctcggactgagc

SEQ ID NO: 30972 - DNA, 19 bp, Homo sapiens
caggcggctcggactgagc

SEQ ID NO: 30973 - DNA, 16 bp, Homo sapiens
aggcggctcggactga

SEQ ID NO: 30974 - DNA, 17 bp, Homo sapiens
caggcggctcggactga

SEQ ID NO: 30975 - DNA, 16 bp, Homo sapiens
caggcggctcggactg

SEQ ID NO: 30976 - DNA, 19 bp, Homo sapiens
aagatggcggaaggcggag

SEQ ID NO: 30977 - DNA, 22 bp, Homo sapiens
aagatggcggaaggcggagcgg

SEQ ID NO: 30978 - DNA, 22 bp, Homo sapiens
atggcggaaggcggagcggcgg

SEQ ID NO: 30979 - DNA, 17 bp, Homo sapiens
tggcggaaggcggagcg

SEQ ID NO: 30980 - DNA, 19 bp, Homo sapiens
tggcggaaggcggagcggc

SEQ ID NO: 30981 - DNA, 19 bp, Homo sapiens
ggcggaaggcggagcggcg

SEQ ID NO: 30982 - DNA, 20 bp, Homo sapiens
ggcggaaggcggagcggcgg

SEQ ID NO: 30983 - DNA, 22 bp, Homo sapiens
ggcggaaggcggagcggcggat

SEQ ID NO: 30984 - DNA, 24 bp, Homo sapiens
ggcggaaggcggagcggcggatct

SEQ ID NO: 30985 - DNA, 18 bp, Homo sapiens
gcggaaggcggagcggcg

SEQ ID NO: 30986 - DNA, 18 bp, Homo sapiens
cggaaggcggagcggcgg

SEQ ID NO: 30987 - DNA, 21 bp, Homo sapiens
cggaaggcggagcggcggatc

SEQ ID NO: 30988 - DNA, 22 bp, Homo sapiens
cggaaggcggagcggcggatct

SEQ ID NO: 30989 - DNA, 18 bp, Homo sapiens
gaaggcggagcggcggat

SEQ ID NO: 30990 - DNA, 21 bp, Homo sapiens
gaaggcggagcggcggatctg

SEQ ID NO: 30991 - DNA, 22 bp, Homo sapiens
aaggcggagcggcggatctgga

SEQ ID NO: 30992 - DNA, 19 bp, Homo sapiens
aggcggagcggcggatctg

SEQ ID NO: 30993 - DNA, 21 bp, Homo sapiens
aggcggagcggcggatctgga

SEQ ID NO: 30994 - DNA, 18 bp, Homo sapiens
ggcggagcggcggatctg

SEQ ID NO: 30995 - DNA, 20 bp, Homo sapiens
ggcggagcggcggatctgga

SEQ ID NO: 30996 - DNA, 17 bp, Homo sapiens
gcggagcggcggatctg

SEQ ID NO: 30997 - DNA, 18 bp, Homo sapiens
gcggagcggcggatctgg

SEQ ID NO: 30998 - DNA, 19 bp, Homo sapiens
gcggagcggcggatctgga

SEQ ID NO: 30999 - DNA, 16 bp, Homo sapiens
cggagcggcggatctg

SEQ ID NO: 31000 - DNA, 18 bp, Homo sapiens
cggagcggcggatctgga

SEQ ID NO: 31001 - DNA, 17 bp, Homo sapiens
ggagcggcggatctgga

SEQ ID NO: 31002 - DNA, 16 bp, Homo sapiens
gagcggcggatctgga

SEQ ID NO: 31003 - DNA, 19 bp, Homo sapiens
tgaggtagtagtttgtgct

SEQ ID NO: 31004 - DNA, 20 bp, Homo sapiens
tgaggtagtagtttgtgctg

SEQ ID NO: 31005 - DNA, 21 bp, Homo sapiens
tgaggtagtagtttgtgctgt

SEQ ID NO: 31006 - DNA, 23 bp, Homo sapiens
tgaggtagtagtttgtgctgttg

SEQ ID NO: 31007 - DNA, 24 bp, Homo sapiens
tgaggtagtagtttgtgctgttgg

SEQ ID NO: 31008 - DNA, 26 bp, Homo sapiens
tgaggtagtagtttgtgctgttggtc

SEQ ID NO: 31009 - DNA, 18 bp, Homo sapiens
ctgcgcaagctactgcct

SEQ ID NO: 31010 - DNA, 19 bp, Homo sapiens
ctgcgcaagctactgcctt

SEQ ID NO: 31011 - DNA, 20 bp, Homo sapiens
ctgcgcaagctactgccttg

SEQ ID NO: 31012 - DNA, 21 bp, Homo sapiens
ctgcgcaagctactgccttgc

SEQ ID NO: 31013 - DNA, 23 bp, Homo sapiens
ctgcgcaagctactgccttgcta

SEQ ID NO: 31014 - DNA, 24 bp, Homo sapiens
ctgcgcaagctactgccttgctag

SEQ ID NO: 31015 - DNA, 26 bp, Homo sapiens
ctgcgcaagctactgccttgctagtg

SEQ ID NO: 31016 - DNA, 22 bp, Homo sapiens
tctcaattacttttgcaccaac

SEQ ID NO: 31017 - DNA, 22 bp, Homo sapiens
attcagaggctaggtggagata

SEQ ID NO: 31018 - DNA, 19 bp, Homo sapiens
ttcagaggctaggtggaga

SEQ ID NO: 31019 - DNA, 20 bp, Homo sapiens
attcagaggctaggtggaga

SEQ ID NO: 31020 - DNA, 22 bp, Homo sapiens
atattcagaggctaggtggaga

SEQ ID NO: 31021 - DNA, 21 bp, Homo sapiens
atattcagaggctaggtggag

SEQ ID NO: 31022 - DNA, 17 bp, Homo sapiens
ttcagaggctaggtgga

SEQ ID NO: 31023 - DNA, 19 bp, Homo sapiens
tattcagaggctaggtgga

SEQ ID NO: 31024 - DNA, 18 bp, Homo sapiens
agctctagaaagattgtt

SEQ ID NO: 31025 - DNA, 19 bp, Homo sapiens
agctctagaaagattgttg

SEQ ID NO: 31026 - DNA, 20 bp, Homo sapiens
agctctagaaagattgttga

SEQ ID NO: 31027 - DNA, 21 bp, Homo sapiens
agctctagaaagattgttgac

SEQ ID NO: 31028 - DNA, 24 bp, Homo sapiens
agctctagaaagattgttgaccaa

SEQ ID NO: 31029 - DNA, 25 bp, Homo sapiens
agctctagaaagattgttgaccaat

SEQ ID NO: 31030 - DNA, 26 bp, Homo sapiens
agctctagaaagattgttgaccaatc

SEQ ID NO: 31031 - DNA, 21 bp, Homo sapiens
gctctagaaagattgttgacc

SEQ ID NO: 31032 - DNA, 28 bp, Homo sapiens
gactagaccatctttctagagtataact

SEQ ID NO: 31033 - DNA, 20 bp, Homo sapiens
tagaccatctttctagagta

SEQ ID NO: 31034 - DNA, 22 bp, Homo sapiens
tagaccatctttctagagtata

SEQ ID NO: 31035 - DNA, 23 bp, Homo sapiens
tagaccatctttctagagtataa

SEQ ID NO: 31036 - DNA, 21 bp, Homo sapiens
accatctttctagagtataac

SEQ ID NO: 31037 - DNA, 21 bp, Homo sapiens
tcctcctgccctccttgctgt

SEQ ID NO: 31038 - DNA, 23 bp, Homo sapiens
tcctcctgccctccttgctgtag

SEQ ID NO: 31039 - DNA, 24 bp, Homo sapiens
tcctcctgccctccttgctgtaga

SEQ ID NO: 31040 - DNA, 21 bp, Homo sapiens
cctcctgccctccttgctgta

SEQ ID NO: 31041 - DNA, 22 bp, Homo sapiens
cctcctgccctccttgctgtag

SEQ ID NO: 31042 - DNA, 23 bp, Homo sapiens
cctcctgccctccttgctgtaga

SEQ ID NO: 31043 - DNA, 24 bp, Homo sapiens
cctcctgccctccttgctgtagac

SEQ ID NO: 31044 - DNA, 19 bp, Homo sapiens
ctcctgccctccttgctgt

SEQ ID NO: 31045 - DNA, 20 bp, Homo sapiens
ctcctgccctccttgctgta

SEQ ID NO: 31046 - DNA, 21 bp, Homo sapiens
ctcctgccctccttgctgtag

SEQ ID NO: 31047 - DNA, 22 bp, Homo sapiens
ctcctgccctccttgctgtaga

SEQ ID NO: 31048 - DNA, 23 bp, Homo sapiens
ctcctgccctccttgctgtagac

SEQ ID NO: 31049 - DNA, 19 bp, Homo sapiens
tcctgccctccttgctgta

SEQ ID NO: 31050 - DNA, 20 bp, Homo sapiens
tcctgccctccttgctgtag

SEQ ID NO: 31051 - DNA, 21 bp, Homo sapiens
tcctgccctccttgctgtaga

SEQ ID NO: 31052 - DNA, 22 bp, Homo sapiens
tcctgccctccttgctgtagac

SEQ ID NO: 31053 - DNA, 20 bp, Homo sapiens
cctgccctccttgctgtaga

SEQ ID NO: 31054 - DNA, 19 bp, Homo sapiens
attgcttctttctaatgcc

SEQ ID NO: 31055 - DNA, 23 bp, Homo sapiens
acatcaagatcagtcccaaatat

SEQ ID NO: 31056 - DNA, 21 bp, Homo sapiens
gacatcaagatcagtcccaaa

SEQ ID NO: 31057 - DNA, 21 bp, Homo sapiens
agacatcaagatcagtcccaa

SEQ ID NO: 31058 - DNA, 22 bp, Homo sapiens
cagacatcaagatcagtcccaa

SEQ ID NO: 31059 - DNA, 21 bp, Homo sapiens
cagacatcaagatcagtccca

SEQ ID NO: 31060 - DNA, 22 bp, Homo sapiens
tgggactgatcttgatgtctgc

SEQ ID NO: 31061 - DNA, 26 bp, Homo sapiens
tgggactgatcttgatgtctgccaag

SEQ ID NO: 31062 - DNA, 21 bp, Homo sapiens
gggactgatcttgatgtctgc

SEQ ID NO: 31063 - DNA, 23 bp, Homo sapiens
gactgatcttgatgtctgccaag

SEQ ID NO: 31064 - DNA, 17 bp, Homo sapiens
tcttgatgtctgccaaa

SEQ ID NO: 31065 - DNA, 18 bp, Homo sapiens
atcttgatgtctgccaaa

SEQ ID NO: 31066 - DNA, 19 bp, Homo sapiens
gatcttgatgtctgccaaa

SEQ ID NO: 31067 - DNA, 20 bp, Homo sapiens
tgatcttgatgtctgccaaa

SEQ ID NO: 31068 - DNA, 21 bp, Homo sapiens
ctgatcttgatgtctgccaaa

SEQ ID NO: 31069 - DNA, 22 bp, Homo sapiens
actgatcttgatgtctgccaaa

SEQ ID NO: 31070 - DNA, 23 bp, Homo sapiens
gactgatcttgatgtctgccaaa

SEQ ID NO: 31071 - DNA, 24 bp, Homo sapiens
ggactgatcttgatgtctgccaaa

SEQ ID NO: 31072 - DNA, 21 bp, Homo sapiens
tggcagacatcaagatcagtc

SEQ ID NO: 31073 - DNA, 21 bp, Homo sapiens
agacatcaagatcagtcccaa

SEQ ID NO: 31074 - DNA, 23 bp, Homo sapiens
agacatcaagatcagtcccaaat

SEQ ID NO: 31075 - DNA, 22 bp, Homo sapiens
acatcaagatcagtcccaaata

SEQ ID NO: 31076 - DNA, 18 bp, Homo sapiens
cgtcttacccagcagtgt

SEQ ID NO: 31077 - DNA, 19 bp, Homo sapiens
cgtcttacccagcagtgtt

SEQ ID NO: 31078 - DNA, 20 bp, Homo sapiens
cgtcttacccagcagtgttt

SEQ ID NO: 31079 - DNA, 21 bp, Homo sapiens
cgtcttacccagcagtgtttg

SEQ ID NO: 31080 - DNA, 23 bp, Homo sapiens
cgtcttacccagcagtgtttggg

SEQ ID NO: 31081 - DNA, 24 bp, Homo sapiens
cgtcttacccagcagtgtttgggt

SEQ ID NO: 31082 - DNA, 19 bp, Homo sapiens
gtcttacccagcagtgttt

SEQ ID NO: 31083 - DNA, 19 bp, Homo sapiens
taatactgccgggtaatga

SEQ ID NO: 31084 - DNA, 20 bp, Homo sapiens
taatactgccgggtaatgat

SEQ ID NO: 31085 - DNA, 21 bp, Homo sapiens
taatactgccgggtaatgatg

SEQ ID NO: 31086 - DNA, 22 bp, Homo sapiens
taatactgccgggtaatgatgg

SEQ ID NO: 31087 - DNA, 24 bp, Homo sapiens
taatactgccgggtaatgatggag

SEQ ID NO: 31088 - DNA, 25 bp, Homo sapiens
taatactgccgggtaatgatggagg

SEQ ID NO: 31089 - DNA, 25 bp, Homo sapiens
tccatcttccagtacagtgttggat

SEQ ID NO: 31090 - DNA, 18 bp, Homo sapiens
catcttccagtacagtgt

SEQ ID NO: 31091 - DNA, 19 bp, Homo sapiens
catcttccagtacagtgtt

SEQ ID NO: 31092 - DNA, 20 bp, Homo sapiens
catcttccagtacagtgttg

SEQ ID NO: 31093 - DNA, 21 bp, Homo sapiens
catcttccagtacagtgttgg

SEQ ID NO: 31094 - DNA, 23 bp, Homo sapiens
catcttccagtacagtgttggat

SEQ ID NO: 31095 - DNA, 24 bp, Homo sapiens
catcttccagtacagtgttggatg

SEQ ID NO: 31096 - DNA, 26 bp, Homo sapiens
catcttccagtacagtgttggatggt

SEQ ID NO: 31097 - DNA, 20 bp, Homo sapiens
atcttccagtacagtgttgg

SEQ ID NO: 31098 - DNA, 23 bp, Homo sapiens
atcttccagtacagtgttggatg

SEQ ID NO: 31099 - DNA, 17 bp, Homo sapiens
taacactgtctggtaaa

SEQ ID NO: 31100 - DNA, 18 bp, Homo sapiens
taacactgtctggtaaag

SEQ ID NO: 31101 - DNA, 19 bp, Homo sapiens
taacactgtctggtaaaga

SEQ ID NO: 31102 - DNA, 20 bp, Homo sapiens
taacactgtctggtaaagat

SEQ ID NO: 31103 - DNA, 21 bp, Homo sapiens
taacactgtctggtaaagatg

SEQ ID NO: 31104 - DNA, 23 bp, Homo sapiens
taacactgtctggtaaagatggc

SEQ ID NO: 31105 - DNA, 24 bp, Homo sapiens
taacactgtctggtaaagatggct

SEQ ID NO: 31106 - DNA, 25 bp, Homo sapiens
taacactgtctggtaaagatggctc

SEQ ID NO: 31107 - DNA, 26 bp, Homo sapiens
taacactgtctggtaaagatggctcc

SEQ ID NO: 31108 - DNA, 28 bp, Homo sapiens
taacactgtctggtaaagatggctcccg

SEQ ID NO: 31109 - DNA, 19 bp, Homo sapiens
acactgtctggtaaagatg

SEQ ID NO: 31110 - DNA, 20 bp, Homo sapiens
agaaggaaattgaattcatt

SEQ ID NO: 31111 - DNA, 21 bp, Homo sapiens
agaaggaaattgaattcattt

SEQ ID NO: 31112 - DNA, 23 bp, Homo sapiens
agaaggaaattgaattcatttag

SEQ ID NO: 31113 - DNA, 21 bp, Homo sapiens
gaaggaaattgaattcattta

SEQ ID NO: 31114 - DNA, 23 bp, Homo sapiens
gaaggaaattgaattcatttaga

SEQ ID NO: 31115 - DNA, 21 bp, Homo sapiens
aaggaaattgaattcatttag

SEQ ID NO: 31116 - DNA, 22 bp, Homo sapiens
aaggaaattgaattcatttaga

SEQ ID NO: 31117 - DNA, 21 bp, Homo sapiens
aatgagcttaatttccttttt

SEQ ID NO: 31118 - DNA, 22 bp, Homo sapiens
aatgagcttaatttcctttttt

SEQ ID NO: 31119 - DNA, 23 bp, Homo sapiens
aatgagcttaatttccttttttc

SEQ ID NO: 31120 - DNA, 21 bp, Homo sapiens
atgagcttaatttcctttttt

SEQ ID NO: 31121 - DNA, 21 bp, Homo sapiens
agacttcccatttgaaggtgg

SEQ ID NO: 31122 - DNA, 22 bp, Homo sapiens
tagacttcccatttgaaggtgg

SEQ ID NO: 31123 - DNA, 23 bp, Homo sapiens
ctagacttcccatttgaaggtgg

SEQ ID NO: 31124 - DNA, 22 bp, Homo sapiens
ctagacttcccatttgaaggtg

SEQ ID NO: 31125 - DNA, 25 bp, Homo sapiens
aaactctacttgtccttctgagtgt

SEQ ID NO: 31126 - DNA, 24 bp, Homo sapiens
aaactctacttgtccttctgagtg

SEQ ID NO: 31127 - DNA, 22 bp, Homo sapiens
aaactctacttgtccttctgag

SEQ ID NO: 31128 - DNA, 21 bp, Homo sapiens
aaactctacttgtccttctga

SEQ ID NO: 31129 - DNA, 20 bp, Homo sapiens
aaactctacttgtccttctg

SEQ ID NO: 31130 - DNA, 20 bp, Homo sapiens
agaagattgcagagtaagtt

SEQ ID NO: 31131 - DNA, 21 bp, Homo sapiens
agaagattgcagagtaagttc

SEQ ID NO: 31132 - DNA, 20 bp, Homo sapiens
gaagattgcagagtaagttc

SEQ ID NO: 31133 - DNA, 22 bp, Homo sapiens
aagattgcagagtaagttcctg

SEQ ID NO: 31134 - DNA, 18 bp, Homo sapiens
agagtaagttcctgatta

SEQ ID NO: 31135 - DNA, 20 bp, Homo sapiens
tggaatttactctgcaatct

SEQ ID NO: 31136 - DNA, 21 bp, Homo sapiens
tggaatttactctgcaatctt

SEQ ID NO: 31137 - DNA, 18 bp, Homo sapiens
aatttactctgcaatctt

SEQ ID NO: 31138 - DNA, 20 bp, Homo sapiens
aatttactctgcaatcttct

SEQ ID NO: 31139 - DNA, 22 bp, Homo sapiens
atgcattaaattattgaaggcc

SEQ ID NO: 31140 - DNA, 23 bp, Homo sapiens
atgcattaaattattgaaggccc

SEQ ID NO: 31141 - DNA, 21 bp, Homo sapiens
tgcattaaattattgaaggcc

SEQ ID NO: 31142 - DNA, 22 bp, Homo sapiens
attaaattattgaaggcccttg

SEQ ID NO: 31143 - DNA, 22 bp, Homo sapiens
aggactgtgtggtgtaaataac

SEQ ID NO: 31144 - DNA, 23 bp, Homo sapiens
taggactgtgtggtgtaaataac

SEQ ID NO: 31145 - DNA, 23 bp, Homo sapiens
aaactaggactgtgtggtgtaaa

SEQ ID NO: 31146 - DNA, 23 bp, Homo sapiens
aaaactaggactgtgtggtgtaa

SEQ ID NO: 31147 - DNA, 20 bp, Homo sapiens
aactaggactgtgtggtgta

SEQ ID NO: 31148 - DNA, 19 bp, Homo sapiens
aactaggactgtgtggtgt

SEQ ID NO: 31149 - DNA, 21 bp, Homo sapiens
aaaactaggactgtgtggtgt

SEQ ID NO: 31150 - DNA, 19 bp, Homo sapiens
aaaaactaggactgtgtgg

SEQ ID NO: 31151 - DNA, 27 bp, Homo sapiens
ccatcgaggacctgcgggacaagattc

SEQ ID NO: 31152 - DNA, 18 bp, Homo sapiens
aggacctgcgggacaaga

SEQ ID NO: 31153 - DNA, 21 bp, Homo sapiens
aggacctgcgggacaagattc

SEQ ID NO: 31154 - DNA, 28 bp, Homo sapiens
aggacctgcgggacaagattcttggtgc

SEQ ID NO: 31155 - DNA, 27 bp, Homo sapiens
gacctgcgggacaagattcttggtgcc

SEQ ID NO: 31156 - DNA, 23 bp, Homo sapiens
tgcgggacaagattcttggtgcc

SEQ ID NO: 31157 - DNA, 22 bp, Homo sapiens
gcgggacaagattcttggtgcc

SEQ ID NO: 31158 - DNA, 21 bp, Homo sapiens
cgggacaagattcttggtgcc

SEQ ID NO: 31159 - DNA, 20 bp, Homo sapiens
gggacaagattcttggtgcc

SEQ ID NO: 31160 - DNA, 19 bp, Homo sapiens
ggacaagattcttggtgcc

SEQ ID NO: 31161 - DNA, 22 bp, Homo sapiens
ttgttctaggtatggtcccagg

SEQ ID NO: 31162 - DNA, 24 bp, Homo sapiens
ttgttctaggtatggtcccaggga

SEQ ID NO: 31163 - DNA, 26 bp, Homo sapiens
ttgttctaggtatggtcccagggatc

SEQ ID NO: 31164 - DNA, 25 bp, Homo sapiens
tgttctaggtatggtcccagggatc

SEQ ID NO: 31165 - DNA, 20 bp, Homo sapiens
ttctaggtatggtcccaggg

SEQ ID NO: 31166 - DNA, 21 bp, Homo sapiens
ttctaggtatggtcccaggga

SEQ ID NO: 31167 - DNA, 22 bp, Homo sapiens
ttctaggtatggtcccagggat

SEQ ID NO: 31168 - DNA, 23 bp, Homo sapiens
ttctaggtatggtcccagggatc

SEQ ID NO: 31169 - DNA, 21 bp, Homo sapiens
tctaggtatggtcccagggat

SEQ ID NO: 31170 - DNA, 22 bp, Homo sapiens
tctaggtatggtcccagggatc

SEQ ID NO: 31171 - DNA, 23 bp, Homo sapiens
tctaggtatggtcccagggatcc

SEQ ID NO: 31172 - DNA, 24 bp, Homo sapiens
tctaggtatggtcccagggatccc

SEQ ID NO: 31173 - DNA, 20 bp, Homo sapiens
ctaggtatggtcccagggat

SEQ ID NO: 31174 - DNA, 21 bp, Homo sapiens
ctaggtatggtcccagggatc

SEQ ID NO: 31175 - DNA, 23 bp, Homo sapiens
ctaggtatggtcccagggatccc

SEQ ID NO: 31176 - DNA, 24 bp, Homo sapiens
ctaggtatggtcccagggatccca

SEQ ID NO: 31177 - DNA, 26 bp, Homo sapiens
ctaggtatggtcccagggatcccaga

SEQ ID NO: 31178 - DNA, 16 bp, Homo sapiens
gtatggtcccagggat

SEQ ID NO: 31179 - DNA, 17 bp, Homo sapiens
gtatggtcccagggatc

SEQ ID NO: 31180 - DNA, 17 bp, Homo sapiens
gcccctgggcctatcct

SEQ ID NO: 31181 - DNA, 18 bp, Homo sapiens
gcccctgggcctatccta

SEQ ID NO: 31182 - DNA, 19 bp, Homo sapiens
gcccctgggcctatcctag

SEQ ID NO: 31183 - DNA, 20 bp, Homo sapiens
gcccctgggcctatcctaga

SEQ ID NO: 31184 - DNA, 22 bp, Homo sapiens
gcccctgggcctatcctagaac

SEQ ID NO: 31185 - DNA, 23 bp, Homo sapiens
gcccctgggcctatcctagaacc

SEQ ID NO: 31186 - DNA, 21 bp, Homo sapiens
cccctgggcctatcctagaac

SEQ ID NO: 31187 - DNA, 22 bp, Homo sapiens
cccctgggcctatcctagaacc

SEQ ID NO: 31188 - DNA, 23 bp, Homo sapiens
atttcctaccctacctgaagact

SEQ ID NO: 31189 - DNA, 20 bp, Homo sapiens
tttcctaccctacctgaaga

SEQ ID NO: 31190 - DNA, 21 bp, Homo sapiens
tttcctaccctacctgaagac

SEQ ID NO: 31191 - DNA, 21 bp, Homo sapiens
ttcctaccctacctgaagact

SEQ ID NO: 31192 - DNA, 19 bp, Homo sapiens
actctagctgccaaaggcg

SEQ ID NO: 31193 - DNA, 20 bp, Homo sapiens
actctagctgccaaaggcgc

SEQ ID NO: 31194 - DNA, 22 bp, Homo sapiens
actctagctgccaaaggcgctt

SEQ ID NO: 31195 - DNA, 23 bp, Homo sapiens
actctagctgccaaaggcgcttc

SEQ ID NO: 31196 - DNA, 24 bp, Homo sapiens
actctagctgccaaaggcgcttct

SEQ ID NO: 31197 - DNA, 25 bp, Homo sapiens
ctctagctgccaaaggcgcttctcc

SEQ ID NO: 31198 - DNA, 17 bp, Homo sapiens
tctagctgccaaaggcg

SEQ ID NO: 31199 - DNA, 21 bp, Homo sapiens
acagagcgctttgctcagcca

SEQ ID NO: 31200 - DNA, 19 bp, Homo sapiens
agcgctttgctcagccagt

SEQ ID NO: 31201 - DNA, 21 bp, Homo sapiens
agcgctttgctcagccagtgt

SEQ ID NO: 31202 - DNA, 23 bp, Homo sapiens
agcgctttgctcagccagtgtag

SEQ ID NO: 31203 - DNA, 24 bp, Homo sapiens
agcgctttgctcagccagtgtaga

SEQ ID NO: 31204 - DNA, 23 bp, Homo sapiens
gcgctttgctcagccagtgtaga

SEQ ID NO: 31205 - DNA, 22 bp, Homo sapiens
cgctttgctcagccagtgtaga

SEQ ID NO: 31206 - DNA, 23 bp, Homo sapiens
ttatggctttttattcctatgtg

SEQ ID NO: 31207 - DNA, 21 bp, Homo sapiens
tatggctttttattcctatgt

SEQ ID NO: 31208 - DNA, 22 bp, Homo sapiens
tatggctttttattcctatgtg

SEQ ID NO: 31209 - DNA, 25 bp, Homo sapiens
tatggctttttattcctatgtgata

SEQ ID NO: 31210 - DNA, 26 bp, Homo sapiens
tatggctttttattcctatgtgatag

SEQ ID NO: 31211 - DNA, 27 bp, Homo sapiens
tatggctttttattcctatgtgatagt

SEQ ID NO: 31212 - DNA, 28 bp, Homo sapiens
tatggctttttattcctatgtgatagta

SEQ ID NO: 31213 - DNA, 22 bp, Homo sapiens
atggctttttattcctatgtga

SEQ ID NO: 31214 - DNA, 23 bp, Homo sapiens
tggctttttattcctatgtgata

SEQ ID NO: 31215 - DNA, 22 bp, Homo sapiens
aatgtaaacaggctttttgctc

SEQ ID NO: 31216 - DNA, 18 bp, Homo sapiens
ttctgagctgaggacagc

SEQ ID NO: 31217 - DNA, 19 bp, Homo sapiens
cttctgagctgaggacagc

SEQ ID NO: 31218 - DNA, 22 bp, Homo sapiens
tagcttctgagctgaggacagc

SEQ ID NO: 31219 - DNA, 23 bp, Homo sapiens
atagcttctgagctgaggacagc

SEQ ID NO: 31220 - DNA, 19 bp, Homo sapiens
gcttctgagctgaggacag

SEQ ID NO: 31221 - DNA, 21 bp, Homo sapiens
tagcttctgagctgaggacag

SEQ ID NO: 31222 - DNA, 16 bp, Homo sapiens
atagcttctgagctga

SEQ ID NO: 31223 - DNA, 21 bp, Homo sapiens
ttcctgagaaaagggccaacg

SEQ ID NO: 31224 - DNA, 22 bp, Homo sapiens
ttcctgagaaaagggccaacgt

SEQ ID NO: 31225 - DNA, 23 bp, Homo sapiens
ttcctgagaaaagggccaacgtg

SEQ ID NO: 31226 - DNA, 24 bp, Homo sapiens
ttcctgagaaaagggccaacgtgc

SEQ ID NO: 31227 - DNA, 21 bp, Homo sapiens
tcctgagaaaagggccaacgt

SEQ ID NO: 31228 - DNA, 16 bp, Homo sapiens
agaagcatcccttgca

SEQ ID NO: 31229 - DNA, 18 bp, Homo sapiens
agaagcatcccttgcagg

SEQ ID NO: 31230 - DNA, 25 bp, Homo sapiens
agaagcatcccttgcaggggctgtt

SEQ ID NO: 31231 - DNA, 18 bp, Homo sapiens
tggagagaaaggcagtag

SEQ ID NO: 31232 - DNA, 19 bp, Homo sapiens
tggagagaaaggcagtagg

SEQ ID NO: 31233 - DNA, 20 bp, Homo sapiens
tggagagaaaggcagtaggt

SEQ ID NO: 31234 - DNA, 21 bp, Homo sapiens
tggagagaaaggcagtaggtc

SEQ ID NO: 31235 - DNA, 22 bp, Homo sapiens
tggagagaaaggcagtaggtct

SEQ ID NO: 31236 - DNA, 23 bp, Homo sapiens
tggagagaaaggcagtaggtctg

SEQ ID NO: 31237 - DNA, 19 bp, Homo sapiens
gagaaaggcagtaggtctg

SEQ ID NO: 31238 - DNA, 22 bp, Homo sapiens
atcatggagttggtaaagcaca

SEQ ID NO: 31239 - DNA, 23 bp, Homo sapiens
tatcatggagttggtaaagcaca

SEQ ID NO: 31240 - DNA, 18 bp, Homo sapiens
atggagttggtaaagcac

SEQ ID NO: 31241 - DNA, 20 bp, Homo sapiens
atcatggagttggtaaagca

SEQ ID NO: 31242 - DNA, 21 bp, Homo sapiens
tatcatggagttggtaaagca

SEQ ID NO: 31243 - DNA, 20 bp, Homo sapiens
tatcatggagttggtaaagc

SEQ ID NO: 31244 - DNA, 23 bp, Homo sapiens
ttttaccacctccaggagactgc

SEQ ID NO: 31245 - DNA, 22 bp, Homo sapiens
ttttaccacctccaggagactg

SEQ ID NO: 31246 - DNA, 21 bp, Homo sapiens
ttttaccacctccaggagact

SEQ ID NO: 31247 - DNA, 19 bp, Homo sapiens
ttttaccacctccaggaga

SEQ ID NO: 31248 - DNA, 26 bp, Homo sapiens
tcaatcacttggtaattgctgtgata

SEQ ID NO: 31249 - DNA, 21 bp, Homo sapiens
tcaatcacttggtaattgctg

SEQ ID NO: 31250 - DNA, 20 bp, Homo sapiens
tcaatcacttggtaattgct

SEQ ID NO: 31251 - DNA, 22 bp, Homo sapiens
gatcaatcacttggtaattgct

SEQ ID NO: 31252 - DNA, 19 bp, Homo sapiens
tcaatcacttggtaattgc

SEQ ID NO: 31253 - DNA, 21 bp, Homo sapiens
gatcaatcacttggtaattgc

SEQ ID NO: 31254 - DNA, 25 bp, Homo sapiens
cctgttgaagtgtaatccccacctc

SEQ ID NO: 31255 - DNA, 23 bp, Homo sapiens
ctgttgaagtgtaatccccacct

SEQ ID NO: 31256 - DNA, 24 bp, Homo sapiens
cctgttgaagtgtaatccccacct

SEQ ID NO: 31257 - DNA, 22 bp, Homo sapiens
cctgttgaagtgtaatccccac

SEQ ID NO: 31258 - DNA, 20 bp, Homo sapiens
tgacctggcagcagggagcg

SEQ ID NO: 31259 - DNA, 21 bp, Homo sapiens
tgacctggcagcagggagcgt

SEQ ID NO: 31260 - DNA, 23 bp, Homo sapiens
tgacctggcagcagggagcgtcg

SEQ ID NO: 31261 - DNA, 17 bp, Homo sapiens
gggagcgtcgtcagtgt

SEQ ID NO: 31262 - DNA, 21 bp, Homo sapiens
gtaaaactgcagttatttttg

SEQ ID NO: 31263 - DNA, 22 bp, Homo sapiens
gtaaaactgcagttatttttgc

SEQ ID NO: 31264 - DNA, 25 bp, Homo sapiens
gtaaaactgcagttatttttgcacc

SEQ ID NO: 31265 - DNA, 20 bp, Homo sapiens
taaaactgcagttatttttg

SEQ ID NO: 31266 - DNA, 22 bp, Homo sapiens
taaaactgcagttatttttgca

SEQ ID NO: 31267 - DNA, 23 bp, Homo sapiens
taaaactgcagttatttttgcac

SEQ ID NO: 31268 - DNA, 23 bp, Homo sapiens
ggctgatgatgatggtgctgaag

SEQ ID NO: 31269 - DNA, 24 bp, Homo sapiens
ggctgatgatgatggtgctgaagg

SEQ ID NO: 31270 - DNA, 26 bp, Homo sapiens
ggctgatgatgatggtgctgaaggct

SEQ ID NO: 31271 - DNA, 27 bp, Homo sapiens
ggctgatgatgatggtgctgaaggctg

SEQ ID NO: 31272 - DNA, 28 bp, Homo sapiens
gtcactgatgtctgtagctgagacggtc

SEQ ID NO: 31273 - DNA, 26 bp, Homo sapiens
gtcactgatgtctgtagctgagacgg

SEQ ID NO: 31274 - DNA, 27 bp, Homo sapiens
agtcactgatgtctgtagctgagacgg

SEQ ID NO: 31275 - DNA, 25 bp, Homo sapiens
gtcactgatgtctgtagctgagacg

SEQ ID NO: 31276 - DNA, 26 bp, Homo sapiens
agtcactgatgtctgtagctgagacg

SEQ ID NO: 31277 - DNA, 22 bp, Homo sapiens
cctggagctactccaccatctc

SEQ ID NO: 31278 - DNA, 21 bp, Homo sapiens
cctggagctactccaccatct

SEQ ID NO: 31279 - DNA, 22 bp, Homo sapiens
gcctggagctactccaccatct

SEQ ID NO: 31280 - DNA, 23 bp, Homo sapiens
tgcctggagctactccaccatct

SEQ ID NO: 31281 - DNA, 21 bp, Homo sapiens
gcctggagctactccaccatc

SEQ ID NO: 31282 - DNA, 19 bp, Homo sapiens
cctggagctactccaccat

SEQ ID NO: 31283 - DNA, 20 bp, Homo sapiens
gcctggagctactccaccat

SEQ ID NO: 31284 - DNA, 18 bp, Homo sapiens
gcctggagctactccacc

SEQ ID NO: 31285 - DNA, 17 bp, Homo sapiens
gcctggagctactccac

SEQ ID NO: 31286 - DNA, 22 bp, Homo sapiens
ccgccctctgtcaccttgcaga

SEQ ID NO: 31287 - DNA, 23 bp, Homo sapiens
ccgccctctgtcaccttgcagac

SEQ ID NO: 31288 - DNA, 24 bp, Homo sapiens
ccgccctctgtcaccttgcagacg

SEQ ID NO: 31289 - DNA, 23 bp, Homo sapiens
cgccctctgtcaccttgcagacg

SEQ ID NO: 31290 - DNA, 16 bp, Homo sapiens
gccctctgtcaccttg

SEQ ID NO: 31291 - DNA, 19 bp, Homo sapiens
gccctctgtcaccttgcag

SEQ ID NO: 31292 - DNA, 20 bp, Homo sapiens
gccctctgtcaccttgcaga

SEQ ID NO: 31293 - DNA, 21 bp, Homo sapiens
gccctctgtcaccttgcagac

SEQ ID NO: 31294 - DNA, 23 bp, Homo sapiens
gccctctgtcaccttgcagacgg

SEQ ID NO: 31295 - DNA, 24 bp, Homo sapiens
gccctctgtcaccttgcagacggc

SEQ ID NO: 31296 - DNA, 20 bp, Homo sapiens
cgaatgtctgcaagtgtcag

SEQ ID NO: 31297 - DNA, 18 bp, Homo sapiens
tctgcaagtgtcagaggc

SEQ ID NO: 31298 - DNA, 20 bp, Homo sapiens
tctgcaagtgtcagaggcga

SEQ ID NO: 31299 - DNA, 21 bp, Homo sapiens
tctgcaagtgtcagaggcgag

SEQ ID NO: 31300 - DNA, 23 bp, Homo sapiens
tctgcaagtgtcagaggcgagga

SEQ ID NO: 31301 - DNA, 24 bp, Homo sapiens
tctgcaagtgtcagaggcgaggag

SEQ ID NO: 31302 - DNA, 25 bp, Homo sapiens
tctgcaagtgtcagaggcgaggagt

SEQ ID NO: 31303 - DNA, 22 bp, Homo sapiens
ctgcaagtgtcagaggcgagga

SEQ ID NO: 31304 - DNA, 21 bp, Homo sapiens
tgcaagtgtcagaggcgagga

SEQ ID NO: 31305 - DNA, 23 bp, Homo sapiens
tgcaagtgtcagaggcgaggagt

SEQ ID NO: 31306 - DNA, 19 bp, Homo sapiens
gtcagaggcgaggagtggc

SEQ ID NO: 31307 - DNA, 22 bp, Homo sapiens
ctgaagtaccagctactcgaga

SEQ ID NO: 31308 - DNA, 23 bp, Homo sapiens
ctgaagtaccagctactcgagag

SEQ ID NO: 31309 - DNA, 18 bp, Homo sapiens
tgaagtaccagctactcg

SEQ ID NO: 31310 - DNA, 21 bp, Homo sapiens
tgaagtaccagctactcgaga

SEQ ID NO: 31311 - DNA, 21 bp, Homo sapiens
ccagctactcgagaggtcaga

SEQ ID NO: 31312 - DNA, 20 bp, Homo sapiens
ttgctcctgaatagctggga

SEQ ID NO: 31313 - DNA, 22 bp, Homo sapiens
ttgctcctgaatagctgggact

SEQ ID NO: 31314 - DNA, 23 bp, Homo sapiens
tccgtgttacctgtcctctaggt

SEQ ID NO: 31315 - DNA, 24 bp, Homo sapiens
ctccgtgttacctgtcctctaggt

SEQ ID NO: 31316 - DNA, 25 bp, Homo sapiens
cctccgtgttacctgtcctctaggt

SEQ ID NO: 31317 - DNA, 22 bp, Homo sapiens
tccgtgttacctgtcctctagg

SEQ ID NO: 31318 - DNA, 23 bp, Homo sapiens
ctccgtgttacctgtcctctagg

SEQ ID NO: 31319 - DNA, 24 bp, Homo sapiens
cctccgtgttacctgtcctctagg

SEQ ID NO: 31320 - DNA, 21 bp, Homo sapiens
tccgtgttacctgtcctctag

SEQ ID NO: 31321 - DNA, 22 bp, Homo sapiens
ctccgtgttacctgtcctctag

SEQ ID NO: 31322 - DNA, 22 bp, Homo sapiens
cctccgtgttacctgtcctcta

SEQ ID NO: 31323 - DNA, 21 bp, Homo sapiens
cctccgtgttacctgtcctct

SEQ ID NO: 31324 - DNA, 20 bp, Homo sapiens
cctccgtgttacctgtcctc

SEQ ID NO: 31325 - DNA, 28 bp, Homo sapiens
tgaggatggatagcaaggaagccgctcc

SEQ ID NO: 31326 - DNA, 25 bp, Homo sapiens
aggatggatagcaaggaagccgctc

SEQ ID NO: 31327 - DNA, 27 bp, Homo sapiens
tgaggatggatagcaaggaagccgctc

SEQ ID NO: 31328 - DNA, 24 bp, Homo sapiens
aggatggatagcaaggaagccgct

SEQ ID NO: 31329 - DNA, 27 bp, Homo sapiens
gatgaggatggatagcaaggaagccgc

SEQ ID NO: 31330 - DNA, 24 bp, Homo sapiens
tgaggatggatagcaaggaagccg

SEQ ID NO: 31331 - DNA, 24 bp, Homo sapiens
atgaggatggatagcaaggaagcc

SEQ ID NO: 31332 - DNA, 25 bp, Homo sapiens
gatgaggatggatagcaaggaagcc

SEQ ID NO: 31333 - DNA, 22 bp, Homo sapiens
tgaggatggatagcaaggaagc

SEQ ID NO: 31334 - DNA, 23 bp, Homo sapiens
atgaggatggatagcaaggaagc

SEQ ID NO: 31335 - DNA, 24 bp, Homo sapiens
gatgaggatggatagcaaggaagc

SEQ ID NO: 31336 - DNA, 21 bp, Homo sapiens
tgaggatggatagcaaggaag

SEQ ID NO: 31337 - DNA, 23 bp, Homo sapiens
gatgaggatggatagcaaggaag

SEQ ID NO: 31338 - DNA, 22 bp, Homo sapiens
gatgaggatggatagcaaggaa

SEQ ID NO: 31339 - DNA, 20 bp, Homo sapiens
atgaggatggatagcaagga

SEQ ID NO: 31340 - DNA, 21 bp, Homo sapiens
gatgaggatggatagcaagga

SEQ ID NO: 31341 - DNA, 19 bp, Homo sapiens
atgaggatggatagcaagg

SEQ ID NO: 31342 - DNA, 20 bp, Homo sapiens
gatgaggatggatagcaagg

SEQ ID NO: 31343 - DNA, 27 bp, Homo sapiens
tagacctagacacctccagttctgggt

SEQ ID NO: 31344 - DNA, 26 bp, Homo sapiens
tagacctagacacctccagttctggg

SEQ ID NO: 31345 - DNA, 22 bp, Homo sapiens
gacctagacacctccagttctg

SEQ ID NO: 31346 - DNA, 23 bp, Homo sapiens
tagacctagacacctccagttct

SEQ ID NO: 31347 - DNA, 19 bp, Homo sapiens
acctagacacctccagttc

SEQ ID NO: 31348 - DNA, 22 bp, Homo sapiens
tagacctagacacctccagttc

SEQ ID NO: 31349 - DNA, 21 bp, Homo sapiens
tagacctagacacctccagtt

SEQ ID NO: 31350 - DNA, 20 bp, Homo sapiens
tagacctagacacctccagt

SEQ ID NO: 31351 - DNA, 16 bp, Homo sapiens
acctagacacctccag

SEQ ID NO: 31352 - DNA, 19 bp, Homo sapiens
tagacctagacacctccag

SEQ ID NO: 31353 - DNA, 18 bp, Homo sapiens
tagacctagacacctcca

SEQ ID NO: 31354 - DNA, 23 bp, Homo sapiens
aagctgggttgagaggatgaaaa

SEQ ID NO: 31355 - DNA, 24 bp, Homo sapiens
aaagctgggttgagaggatgaaaa

SEQ ID NO: 31356 - DNA, 25 bp, Homo sapiens
aaaagctgggttgagaggatgaaaa

SEQ ID NO: 31357 - DNA, 26 bp, Homo sapiens
gaaaagctgggttgagaggatgaaaa

SEQ ID NO: 31358 - DNA, 22 bp, Homo sapiens
aaaagctgggttgagaggatga

SEQ ID NO: 31359 - DNA, 24 bp, Homo sapiens
agaaaagctgggttgagaggatga

SEQ ID NO: 31360 - DNA, 21 bp, Homo sapiens
aaaagctgggttgagaggatg

SEQ ID NO: 31361 - DNA, 23 bp, Homo sapiens
agaaaagctgggttgagaggatg

SEQ ID NO: 31362 - DNA, 27 bp, Homo sapiens
gttgagaaaagctgggttgagaggatg

SEQ ID NO: 31363 - DNA, 21 bp, Homo sapiens
catgtggctagcaacagcgct

SEQ ID NO: 31364 - DNA, 21 bp, Homo sapiens
ctagcaacagcgcttaccttt

SEQ ID NO: 31365 - DNA, 18 bp, Homo sapiens
ctacagtcagacagcctg

SEQ ID NO: 31366 - DNA, 19 bp, Homo sapiens
agttctacagtcagacagc

SEQ ID NO: 31367 - DNA, 20 bp, Homo sapiens
gagttctacagtcagacagc

SEQ ID NO: 31368 - DNA, 19 bp, Homo sapiens
gagttctacagtcagacag

SEQ ID NO: 31369 - DNA, 18 bp, Homo sapiens
gagttctacagtcagaca

SEQ ID NO: 31370 - DNA, 19 bp, Homo sapiens
tgagttctacagtcagaca

SEQ ID NO: 31371 - DNA, 20 bp, Homo sapiens
atgagttctacagtcagaca

SEQ ID NO: 31372 - DNA, 18 bp, Homo sapiens
tgagttctacagtcagac

SEQ ID NO: 31373 - DNA, 24 bp, Homo sapiens
tttccctttccatcctggcaggct

SEQ ID NO: 31374 - DNA, 23 bp, Homo sapiens
tttccctttccatcctggcaggc

SEQ ID NO: 31375 - DNA, 21 bp, Homo sapiens
ttccctttccatcctggcagg

SEQ ID NO: 31376 - DNA, 22 bp, Homo sapiens
tttccctttccatcctggcagg

SEQ ID NO: 31377 - DNA, 23 bp, Homo sapiens
ctttccctttccatcctggcagg

SEQ ID NO: 31378 - DNA, 20 bp, Homo sapiens
tttccctttccatcctggca

SEQ ID NO: 31379 - DNA, 27 bp, Homo sapiens
ttgccagggcaggaggtggaagggagc

SEQ ID NO: 31380 - DNA, 28 bp, Homo sapiens
tttgccagggcaggaggtggaagggagc

SEQ ID NO: 31381 - DNA, 26 bp, Homo sapiens
ttgccagggcaggaggtggaagggag

SEQ ID NO: 31382 - DNA, 27 bp, Homo sapiens
tttgccagggcaggaggtggaagggag

SEQ ID NO: 31383 - DNA, 24 bp, Homo sapiens
ttgccagggcaggaggtggaaggg

SEQ ID NO: 31384 - DNA, 25 bp, Homo sapiens
tttgccagggcaggaggtggaaggg

SEQ ID NO: 31385 - DNA, 23 bp, Homo sapiens
ttgccagggcaggaggtggaagg

SEQ ID NO: 31386 - DNA, 22 bp, Homo sapiens
ttgccagggcaggaggtggaag

SEQ ID NO: 31387 - DNA, 20 bp, Homo sapiens
tgggttcagtgatcgtctct

SEQ ID NO: 31388 - DNA, 23 bp, Homo sapiens
cgacccactcttggtttccaggg

SEQ ID NO: 31389 - DNA, 22 bp, Homo sapiens
cgacccactcttggtttccagg

SEQ ID NO: 31390 - DNA, 23 bp, Homo sapiens
gcgacccactcttggtttccagg

SEQ ID NO: 31391 - DNA, 21 bp, Homo sapiens
cgacccactcttggtttccag

SEQ ID NO: 31392 - DNA, 22 bp, Homo sapiens
gcgacccactcttggtttccag

SEQ ID NO: 31393 - DNA, 20 bp, Homo sapiens
gcgacccactcttggtttcc

SEQ ID NO: 31394 - DNA, 22 bp, Homo sapiens
aggcgacccactcttggtttcc

SEQ ID NO: 31395 - DNA, 19 bp, Homo sapiens
gcgacccactcttggtttc

SEQ ID NO: 31396 - DNA, 27 bp, Homo sapiens
acaaaaaaaaaagcccaacccttcaca

SEQ ID NO: 31397 - DNA, 25 bp, Homo sapiens
acaaaaaaaaaagcccaacccttca

SEQ ID NO: 31398 - DNA, 25 bp, Homo sapiens
aacaaaaaaaaaagcccaacccttc

SEQ ID NO: 31399 - DNA, 18 bp, Homo sapiens
aaaaaaagcccaaccctt

SEQ ID NO: 31400 - DNA, 21 bp, Homo sapiens
aaaaaaaaaagcccaaccctt

SEQ ID NO: 31401 - DNA, 23 bp, Homo sapiens
acaaaaaaaaaagcccaaccctt

SEQ ID NO: 31402 - DNA, 22 bp, Homo sapiens
acaaaaaaaaaagcccaaccct

SEQ ID NO: 31403 - DNA, 21 bp, Homo sapiens
acaaaaaaaaaagcccaaccc

SEQ ID NO: 31404 - DNA, 20 bp, Homo sapiens
acaaaaaaaaaagcccaacc

SEQ ID NO: 31405 - DNA, 17 bp, Homo sapiens
ttaggaacaaaaaaaaa

SEQ ID NO: 31406 - DNA, 25 bp, Homo sapiens
tgttgtacttttttttttgttcgtt

SEQ ID NO: 31407 - DNA, 24 bp, Homo sapiens
tgttgtacttttttttttgttcgt

SEQ ID NO: 31408 - DNA, 23 bp, Homo sapiens
tgttgtacttttttttttgttcg

SEQ ID NO: 31409 - DNA, 21 bp, Homo sapiens
gttgtacttttttttttgttc

SEQ ID NO: 31410 - DNA, 20 bp, Homo sapiens
gttgtacttttttttttgtt

SEQ ID NO: 31411 - DNA, 21 bp, Homo sapiens
tgttgtacttttttttttgtt

SEQ ID NO: 31412 - DNA, 20 bp, Homo sapiens
tgttgtacttttttttttgt

SEQ ID NO: 31413 - DNA, 24 bp, Homo sapiens
tggattgttgtacttttttttttg

SEQ ID NO: 31414 - DNA, 28 bp, Homo sapiens
ccagtattaactgtgctgctgaagtaag

SEQ ID NO: 31415 - DNA, 25 bp, Homo sapiens
ccagtattaactgtgctgctgaagt

SEQ ID NO: 31416 - DNA, 24 bp, Homo sapiens
ccagtattaactgtgctgctgaag

SEQ ID NO: 31417 - DNA, 21 bp, Homo sapiens
agtattaactgtgctgctgaa

SEQ ID NO: 31418 - DNA, 23 bp, Homo sapiens
ccagtattaactgtgctgctgaa

SEQ ID NO: 31419 - DNA, 21 bp, Homo sapiens
cagtattaactgtgctgctga

SEQ ID NO: 31420 - DNA, 21 bp, Homo sapiens
ccagtattaactgtgctgctg

SEQ ID NO: 31421 - DNA, 23 bp, Homo sapiens
ctccagtattaactgtgctgctg

SEQ ID NO: 31422 - DNA, 25 bp, Homo sapiens
atctccagtattaactgtgctgctg

SEQ ID NO: 31423 - DNA, 20 bp, Homo sapiens
ccagtattaactgtgctgct

SEQ ID NO: 31424 - DNA, 22 bp, Homo sapiens
ctccagtattaactgtgctgct

SEQ ID NO: 31425 - DNA, 23 bp, Homo sapiens
tctccagtattaactgtgctgct

SEQ ID NO: 31426 - DNA, 19 bp, Homo sapiens
ccagtattaactgtgctgc

SEQ ID NO: 31427 - DNA, 21 bp, Homo sapiens
ctccagtattaactgtgctgc

SEQ ID NO: 31428 - DNA, 22 bp, Homo sapiens
tctccagtattaactgtgctgc

SEQ ID NO: 31429 - DNA, 18 bp, Homo sapiens
ccagtattaactgtgctg

SEQ ID NO: 31430 - DNA, 17 bp, Homo sapiens
ccagtattaactgtgct

SEQ ID NO: 31431 - DNA, 19 bp, Homo sapiens
ctccagtattaactgtgct

SEQ ID NO: 31432 - DNA, 21 bp, Homo sapiens
atctccagtattaactgtgct

SEQ ID NO: 31433 - DNA, 20 bp, Homo sapiens
atctccagtattaactgtgc

SEQ ID NO: 31434 - DNA, 25 bp, Homo sapiens
cagcacgtaaatattggcgttaaga

SEQ ID NO: 31435 - DNA, 28 bp, Homo sapiens
tagcagcacgtaaatattggcgttaaga

SEQ ID NO: 31436 - DNA, 24 bp, Homo sapiens
cagcacgtaaatattggcgttaag

SEQ ID NO: 31437 - DNA, 27 bp, Homo sapiens
tagcagcacgtaaatattggcgttaag

SEQ ID NO: 31438 - DNA, 23 bp, Homo sapiens
cagcacgtaaatattggcgttaa

SEQ ID NO: 31439 - DNA, 26 bp, Homo sapiens
tagcagcacgtaaatattggcgttaa

SEQ ID NO: 31440 - DNA, 22 bp, Homo sapiens
cagcacgtaaatattggcgtta

SEQ ID NO: 31441 - DNA, 25 bp, Homo sapiens
tagcagcacgtaaatattggcgtta

SEQ ID NO: 31442 - DNA, 19 bp, Homo sapiens
gcacgtaaatattggcgtt

SEQ ID NO: 31443 - DNA, 21 bp, Homo sapiens
cagcacgtaaatattggcgtt

SEQ ID NO: 31444 - DNA, 23 bp, Homo sapiens
agcagcacgtaaatattggcgtt

SEQ ID NO: 31445 - DNA, 24 bp, Homo sapiens
tagcagcacgtaaatattggcgtt

SEQ ID NO: 31446 - DNA, 23 bp, Homo sapiens
ttagcagcacgtaaatattggcg

SEQ ID NO: 31447 - DNA, 18 bp, Homo sapiens
cagcacgtaaatattggc

SEQ ID NO: 31448 - DNA, 17 bp, Homo sapiens
cagcacgtaaatattgg

SEQ ID NO: 31449 - DNA, 20 bp, Homo sapiens
tagcagcacgtaaatattgg

SEQ ID NO: 31450 - DNA, 24 bp, Homo sapiens
caggccatattgtgctgcctcaaa

SEQ ID NO: 31451 - DNA, 23 bp, Homo sapiens
caggccatattgtgctgcctcaa

SEQ ID NO: 31452 - DNA, 21 bp, Homo sapiens
aggccatattgtgctgcctca

SEQ ID NO: 31453 - DNA, 21 bp, Homo sapiens
caggccatattgtgctgcctc

SEQ ID NO: 31454 - DNA, 20 bp, Homo sapiens
caggccatattgtgctgcct

SEQ ID NO: 31455 - DNA, 19 bp, Homo sapiens
caggccatattgtgctgcc

SEQ ID NO: 31456 - DNA, 17 bp, Homo sapiens
caggccatattgtgctg

SEQ ID NO: 31457 - DNA, 23 bp, Homo sapiens
cagcacataatggtttgtggatt

SEQ ID NO: 31458 - DNA, 22 bp, Homo sapiens
cagcacataatggtttgtggat

SEQ ID NO: 31459 - DNA, 21 bp, Homo sapiens
cagcacataatggtttgtgga

SEQ ID NO: 31460 - DNA, 24 bp, Homo sapiens
tagcagcacataatggtttgtgga

SEQ ID NO: 31461 - DNA, 20 bp, Homo sapiens
cagcacataatggtttgtgg

SEQ ID NO: 31462 - DNA, 23 bp, Homo sapiens
tagcagcacataatggtttgtgg

SEQ ID NO: 31463 - DNA, 19 bp, Homo sapiens
cagcacataatggtttgtg

SEQ ID NO: 31464 - DNA, 18 bp, Homo sapiens
cagcacataatggtttgt

SEQ ID NO: 31465 - DNA, 20 bp, Homo sapiens
agcagcacataatggtttgt

SEQ ID NO: 31466 - DNA, 21 bp, Homo sapiens
tagcagcacataatggtttgt

SEQ ID NO: 31467 - DNA, 23 bp, Homo sapiens
aacaggtgactggttagacaaac

SEQ ID NO: 31468 - DNA, 22 bp, Homo sapiens
aacaggtgactggttagacaaa

SEQ ID NO: 31469 - DNA, 22 bp, Homo sapiens
caacaggtgactggttagacaa

SEQ ID NO: 31470 - DNA, 20 bp, Homo sapiens
aacaggtgactggttagaca

SEQ ID NO: 31471 - DNA, 21 bp, Homo sapiens
caacaggtgactggttagaca

SEQ ID NO: 31472 - DNA, 19 bp, Homo sapiens
aacaggtgactggttagac

SEQ ID NO: 31473 - DNA, 18 bp, Homo sapiens
aacaggtgactggttaga

SEQ ID NO: 31474 - DNA, 24 bp, Homo sapiens
tgtttaaccttttgcctgttggtt

SEQ ID NO: 31475 - DNA, 23 bp, Homo sapiens
tgtttaaccttttgcctgttggt

SEQ ID NO: 31476 - DNA, 22 bp, Homo sapiens
tgtttaaccttttgcctgttgg

SEQ ID NO: 31477 - DNA, 23 bp, Homo sapiens
ttgtttaaccttttgcctgttgg

SEQ ID NO: 31478 - DNA, 25 bp, Homo sapiens
gtttgtttaaccttttgcctgttgg

SEQ ID NO: 31479 - DNA, 21 bp, Homo sapiens
tgtttaaccttttgcctgttg

SEQ ID NO: 31480 - DNA, 26 bp, Homo sapiens
cagtggctctgaaatgaactcaaact

SEQ ID NO: 31481 - DNA, 26 bp, Homo sapiens
gcagtggctctgaaatgaactcaaac

SEQ ID NO: 31482 - DNA, 22 bp, Homo sapiens
agtggctctgaaatgaactcaa

SEQ ID NO: 31483 - DNA, 21 bp, Homo sapiens
agtggctctgaaatgaactca

SEQ ID NO: 31484 - DNA, 22 bp, Homo sapiens
cagtggctctgaaatgaactca

SEQ ID NO: 31485 - DNA, 23 bp, Homo sapiens
gcagtggctctgaaatgaactca

SEQ ID NO: 31486 - DNA, 19 bp, Homo sapiens
agtggctctgaaatgaact

SEQ ID NO: 31487 - DNA, 21 bp, Homo sapiens
gcagtggctctgaaatgaact

SEQ ID NO: 31488 - DNA, 18 bp, Homo sapiens
agtggctctgaaatgaac

SEQ ID NO: 31489 - DNA, 20 bp, Homo sapiens
gcagtggctctgaaatgaac

SEQ ID NO: 31490 - DNA, 20 bp, Homo sapiens
tagcaatacagtacaaatat

SEQ ID NO: 31491 - DNA, 22 bp, Homo sapiens
tagcaatacagtacaaatatag

SEQ ID NO: 31492 - DNA, 20 bp, Homo sapiens
ttgcactgtagttgtattgt

SEQ ID NO: 31493 - DNA, 22 bp, Homo sapiens
tgcactgtagttgtattgtatt

SEQ ID NO: 31494 - DNA, 19 bp, Homo sapiens
tgtagttgtattgtattgc

SEQ ID NO: 31495 - DNA, 20 bp, Homo sapiens
tgtagttgtattgtattgcc

SEQ ID NO: 31496 - DNA, 23 bp, Homo sapiens
tgtagttgtattgtattgccact

SEQ ID NO: 31497 - DNA, 24 bp, Homo sapiens
tgtagttgtattgtattgccactc

SEQ ID NO: 31498 - DNA, 21 bp, Homo sapiens
gtagttgtattgtattgccac

SEQ ID NO: 31499 - DNA, 22 bp, Homo sapiens
gtagttgtattgtattgccact

SEQ ID NO: 31500 - DNA, 23 bp, Homo sapiens
ttcaagtaattcaggtgtagtga

SEQ ID NO: 31501 - DNA, 22 bp, Homo sapiens
ttcaagtaattcaggtgtagtg

SEQ ID NO: 31502 - DNA, 21 bp, Homo sapiens
ttcaagtaattcaggtgtagt

SEQ ID NO: 31503 - DNA, 20 bp, Homo sapiens
ttcaagtaattcaggtgtag

SEQ ID NO: 31504 - DNA, 19 bp, Homo sapiens
ttcaagtaattcaggtgta

SEQ ID NO: 31505 - DNA, 18 bp, Homo sapiens
ttcaagtaattcaggtgt

SEQ ID NO: 31506 - DNA, 16 bp, Homo sapiens
ttcaagtaattcaggt

SEQ ID NO: 31507 - DNA, 18 bp, Homo sapiens
agctaaatcatatgaacc

SEQ ID NO: 31508 - DNA, 23 bp, Homo sapiens
atatgaaccaaactctaattagt

SEQ ID NO: 31509 - DNA, 22 bp, Homo sapiens
tgaaccaaactctaattagtca

SEQ ID NO: 31510 - DNA, 19 bp, Homo sapiens
gcttggcacatagcacaaa

SEQ ID NO: 31511 - DNA, 20 bp, Homo sapiens
ggactgtgcttggcacatag

SEQ ID NO: 31512 - DNA, 21 bp, Homo sapiens
aggactgtgcttggcacatag

SEQ ID NO: 31513 - DNA, 20 bp, Homo sapiens
gacactaggcatgtgagtga

SEQ ID NO: 31514 - DNA, 21 bp, Homo sapiens
gacactaggcatgtgagtgat

SEQ ID NO: 31515 - DNA, 23 bp, Homo sapiens
gacactaggcatgtgagtgattg

SEQ ID NO: 31516 - DNA, 22 bp, Homo sapiens
acactaggcatgtgagtgattg

SEQ ID NO: 31517 - DNA, 17 bp, Homo sapiens
actcaatcagtcacata

SEQ ID NO: 31518 - DNA, 22 bp, Homo sapiens
atcagtcacatatctagtgtct

SEQ ID NO: 31519 - DNA, 20 bp, Homo sapiens
tcagtcacatatctagtgtc

SEQ ID NO: 31520 - DNA, 23 bp, Homo sapiens
cagtcacatatctagtgtctaga

SEQ ID NO: 31521 - DNA, 19 bp, Homo sapiens
catatctagtgtctagaat

SEQ ID NO: 31522 - DNA, 20 bp, Homo sapiens
catatctagtgtctagaatg

SEQ ID NO: 31523 - DNA, 21 bp, Homo sapiens
catatctagtgtctagaatga

SEQ ID NO: 31524 - DNA, 19 bp, Homo sapiens
ttcagtgttcagagatgga

SEQ ID NO: 31525 - DNA, 20 bp, Homo sapiens
ttcagtgttcagagatggag

SEQ ID NO: 31526 - DNA, 21 bp, Homo sapiens
ttcagtgttcagagatggagt

SEQ ID NO: 31527 - DNA, 22 bp, Homo sapiens
ttcagtgttcagagatggagtc

SEQ ID NO: 31528 - DNA, 23 bp, Homo sapiens
ttcagtgttcagagatggagtca

SEQ ID NO: 31529 - DNA, 23 bp, Homo sapiens
agcagcagcaggtgcggggcggc

SEQ ID NO: 31530 - DNA, 21 bp, Homo sapiens
agcagcagcaggtgcggggcg

SEQ ID NO: 31531 - DNA, 24 bp, Homo sapiens
cctagggggtggcaggctggccat

SEQ ID NO: 31532 - DNA, 19 bp, Homo sapiens
ctagggggtggcaggctgg

SEQ ID NO: 31533 - DNA, 21 bp, Homo sapiens
ctagggggtggcaggctggcc

SEQ ID NO: 31534 - DNA, 22 bp, Homo sapiens
ctagggggtggcaggctggcca

SEQ ID NO: 31535 - DNA, 23 bp, Homo sapiens
ctagggggtggcaggctggccat

SEQ ID NO: 31536 - DNA, 24 bp, Homo sapiens
ctagggggtggcaggctggccatc

SEQ ID NO: 31537 - DNA, 19 bp, Homo sapiens
tagggggtggcaggctggc

SEQ ID NO: 31538 - DNA, 21 bp, Homo sapiens
agggggtggcaggctggccat

SEQ ID NO: 31539 - DNA, 20 bp, Homo sapiens
ggggtggcaggctggccatc

SEQ ID NO: 31540 - DNA, 27 bp, Homo sapiens
gtgggctaaccctgtcctctccctccc

SEQ ID NO: 31541 - DNA, 19 bp, Homo sapiens
ctaaccctgtcctctccct

SEQ ID NO: 31542 - DNA, 21 bp, Homo sapiens
ctaaccctgtcctctccctcc

SEQ ID NO: 31543 - DNA, 22 bp, Homo sapiens
ctaaccctgtcctctccctccc

SEQ ID NO: 31544 - DNA, 24 bp, Homo sapiens
ctaaccctgtcctctccctcccag

SEQ ID NO: 31545 - DNA, 25 bp, Homo sapiens
ctaaccctgtcctctccctcccagc

SEQ ID NO: 31546 - DNA, 21 bp, Homo sapiens
taaccctgtcctctccctccc

SEQ ID NO: 31547 - DNA, 22 bp, Homo sapiens
taaccctgtcctctccctccca

SEQ ID NO: 31548 - DNA, 24 bp, Homo sapiens
taaccctgtcctctccctcccagc

SEQ ID NO: 31549 - DNA, 25 bp, Homo sapiens
taaccctgtcctctccctcccagcc

SEQ ID NO: 31550 - DNA, 24 bp, Homo sapiens
ttccatgcctcctagaagttccga

SEQ ID NO: 31551 - DNA, 23 bp, Homo sapiens
ttccatgcctcctagaagttccg

SEQ ID NO: 31552 - DNA, 23 bp, Homo sapiens
tttccatgcctcctagaagttcc

SEQ ID NO: 31553 - DNA, 21 bp, Homo sapiens
ttccatgcctcctagaagttc

SEQ ID NO: 31554 - DNA, 22 bp, Homo sapiens
tttccatgcctcctagaagttc

SEQ ID NO: 31555 - DNA, 20 bp, Homo sapiens
ttccatgcctcctagaagtt

SEQ ID NO: 31556 - DNA, 21 bp, Homo sapiens
tttccatgcctcctagaagtt

SEQ ID NO: 31557 - DNA, 19 bp, Homo sapiens
ttccatgcctcctagaagt

SEQ ID NO: 31558 - DNA, 20 bp, Homo sapiens
tttccatgcctcctagaagt

SEQ ID NO: 31559 - DNA, 25 bp, Homo sapiens
gccttccaggagaaatggagaccct

SEQ ID NO: 31560 - DNA, 24 bp, Homo sapiens
gccttccaggagaaatggagaccc

SEQ ID NO: 31561 - DNA, 25 bp, Homo sapiens
agccttccaggagaaatggagaccc

SEQ ID NO: 31562 - DNA, 23 bp, Homo sapiens
gccttccaggagaaatggagacc

SEQ ID NO: 31563 - DNA, 24 bp, Homo sapiens
agccttccaggagaaatggagacc

SEQ ID NO: 31564 - DNA, 22 bp, Homo sapiens
gccttccaggagaaatggagac

SEQ ID NO: 31565 - DNA, 23 bp, Homo sapiens
agccttccaggagaaatggagac

SEQ ID NO: 31566 - DNA, 21 bp, Homo sapiens
gccttccaggagaaatggaga

SEQ ID NO: 31567 - DNA, 23 bp, Homo sapiens
aagccttccaggagaaatggaga

SEQ ID NO: 31568 - DNA, 20 bp, Homo sapiens
gccttccaggagaaatggag

SEQ ID NO: 31569 - DNA, 21 bp, Homo sapiens
agccttccaggagaaatggag

SEQ ID NO: 31570 - DNA, 20 bp, Homo sapiens
agccttccaggagaaatgga

SEQ ID NO: 31571 - DNA, 18 bp, Homo sapiens
agccttccaggagaaatg

SEQ ID NO: 31572 - DNA, 25 bp, Homo sapiens
catgagtgttgtctacgagggcatc

SEQ ID NO: 31573 - DNA, 18 bp, Homo sapiens
tgagtgttgtctacgagg

SEQ ID NO: 31574 - DNA, 19 bp, Homo sapiens
tgagtgttgtctacgaggg

SEQ ID NO: 31575 - DNA, 20 bp, Homo sapiens
tgagtgttgtctacgagggc

SEQ ID NO: 31576 - DNA, 22 bp, Homo sapiens
tgagtgttgtctacgagggcat

SEQ ID NO: 31577 - DNA, 23 bp, Homo sapiens
tgagtgttgtctacgagggcatc

SEQ ID NO: 31578 - DNA, 24 bp, Homo sapiens
tgagtgttgtctacgagggcatcc

SEQ ID NO: 31579 - DNA, 25 bp, Homo sapiens
tgagtgttgtctacgagggcatcct

SEQ ID NO: 31580 - DNA, 21 bp, Homo sapiens
gagtgttgtctacgagggcat

SEQ ID NO: 31581 - DNA, 17 bp, Homo sapiens
ctacgagggcatccttg

SEQ ID NO: 31582 - DNA, 23 bp, Homo sapiens
tgaggtagtagtttcttgaactt

SEQ ID NO: 31583 - DNA, 21 bp, Homo sapiens
gaggtagtagtttcttgaact

SEQ ID NO: 31584 - DNA, 22 bp, Homo sapiens
tgaggtagtagtttcttgaact

SEQ ID NO: 31585 - DNA, 21 bp, Homo sapiens
tgaggtagtagtttcttgaac

SEQ ID NO: 31586 - DNA, 20 bp, Homo sapiens
tgaggtagtagtttcttgaa

SEQ ID NO: 31587 - DNA, 19 bp, Homo sapiens
tgaggtagtagtttcttga

SEQ ID NO: 31588 - DNA, 17 bp, Homo sapiens
gaggtagtagtttcttg

SEQ ID NO: 31589 - DNA, 18 bp, Homo sapiens
tgaggtagtagtttcttg

SEQ ID NO: 31590 - DNA, 20 bp, Homo sapiens
caaagtgcttacagtgcagg

SEQ ID NO: 31591 - DNA, 21 bp, Homo sapiens
caaagtgcttacagtgcaggt

SEQ ID NO: 31592 - DNA, 22 bp, Homo sapiens
caaagtgcttacagtgcaggta

SEQ ID NO: 31593 - DNA, 24 bp, Homo sapiens
caaagtgcttacagtgcaggtagt

SEQ ID NO: 31594 - DNA, 25 bp, Homo sapiens
caaagtgcttacagtgcaggtagtg

SEQ ID NO: 31595 - DNA, 28 bp, Homo sapiens
caaagtgcttacagtgcaggtagtgata

SEQ ID NO: 31596 - DNA, 18 bp, Homo sapiens
actgcagtgaaggcactt

SEQ ID NO: 31597 - DNA, 19 bp, Homo sapiens
actgcagtgaaggcacttg

SEQ ID NO: 31598 - DNA, 20 bp, Homo sapiens
actgcagtgaaggcacttgt

SEQ ID NO: 31599 - DNA, 21 bp, Homo sapiens
actgcagtgaaggcacttgta

SEQ ID NO: 31600 - DNA, 23 bp, Homo sapiens
actgcagtgaaggcacttgtagc

SEQ ID NO: 31601 - DNA, 24 bp, Homo sapiens
actgcagtgaaggcacttgtagca

SEQ ID NO: 31602 - DNA, 26 bp, Homo sapiens
actgcagtgaaggcacttgtagcatt

SEQ ID NO: 31603 - DNA, 21 bp, Homo sapiens
ctgcagtgaaggcacttgtag

SEQ ID NO: 31604 - DNA, 25 bp, Homo sapiens
ctgcagtgaaggcacttgtagcatt

SEQ ID NO: 31605 - DNA, 20 bp, Homo sapiens
taaggtgcatctagtgcaga

SEQ ID NO: 31606 - DNA, 21 bp, Homo sapiens
taaggtgcatctagtgcagat

SEQ ID NO: 31607 - DNA, 22 bp, Homo sapiens
taaggtgcatctagtgcagata

SEQ ID NO: 31608 - DNA, 24 bp, Homo sapiens
taaggtgcatctagtgcagatagt

SEQ ID NO: 31609 - DNA, 25 bp, Homo sapiens
taaggtgcatctagtgcagatagtg

SEQ ID NO: 31610 - DNA, 18 bp, Homo sapiens
actgccctaagtgctcct

SEQ ID NO: 31611 - DNA, 19 bp, Homo sapiens
actgccctaagtgctcctt

SEQ ID NO: 31612 - DNA, 20 bp, Homo sapiens
actgccctaagtgctccttc

SEQ ID NO: 31613 - DNA, 21 bp, Homo sapiens
actgccctaagtgctccttct

SEQ ID NO: 31614 - DNA, 22 bp, Homo sapiens
actgccctaagtgctccttctg

SEQ ID NO: 31615 - DNA, 24 bp, Homo sapiens
actgccctaagtgctccttctggc

SEQ ID NO: 31616 - DNA, 25 bp, Homo sapiens
actgccctaagtgctccttctggca

SEQ ID NO: 31617 - DNA, 27 bp, Homo sapiens
actgccctaagtgctccttctggcata

SEQ ID NO: 31618 - DNA, 26 bp, Homo sapiens
ctgccctaagtgctccttctggcata

SEQ ID NO: 31619 - DNA, 18 bp, Homo sapiens
tagttttgcatagttgca

SEQ ID NO: 31620 - DNA, 20 bp, Homo sapiens
tagttttgcatagttgcact

SEQ ID NO: 31621 - DNA, 21 bp, Homo sapiens
tagttttgcatagttgcacta

SEQ ID NO: 31622 - DNA, 22 bp, Homo sapiens
tagttttgcatagttgcactac

SEQ ID NO: 31623 - DNA, 23 bp, Homo sapiens
tagttttgcatagttgcactaca

SEQ ID NO: 31624 - DNA, 25 bp, Homo sapiens
tagttttgcatagttgcactacaag

SEQ ID NO: 31625 - DNA, 18 bp, Homo sapiens
agttttgcatagttgcac

SEQ ID NO: 31626 - DNA, 19 bp, Homo sapiens
agttttgcatagttgcact

SEQ ID NO: 31627 - DNA, 20 bp, Homo sapiens
agttttgcatagttgcacta

SEQ ID NO: 31628 - DNA, 21 bp, Homo sapiens
agttttgcatagttgcactac

SEQ ID NO: 31629 - DNA, 23 bp, Homo sapiens
ttttgcatagttgcactacaaga

SEQ ID NO: 31630 - DNA, 24 bp, Homo sapiens
ttgtgcaaatctatgcaaaactga

SEQ ID NO: 31631 - DNA, 26 bp, Homo sapiens
ttgtgcaaatctatgcaaaactgatg

SEQ ID NO: 31632 - DNA, 19 bp, Homo sapiens
tgtgcaaatctatgcaaaa

SEQ ID NO: 31633 - DNA, 20 bp, Homo sapiens
tgtgcaaatctatgcaaaac

SEQ ID NO: 31634 - DNA, 21 bp, Homo sapiens
tgtgcaaatctatgcaaaact

SEQ ID NO: 31635 - DNA, 22 bp, Homo sapiens
tgtgcaaatctatgcaaaactg

SEQ ID NO: 31636 - DNA, 24 bp, Homo sapiens
tgtgcaaatctatgcaaaactgat

SEQ ID NO: 31637 - DNA, 25 bp, Homo sapiens
tgtgcaaatctatgcaaaactgatg

SEQ ID NO: 31638 - DNA, 27 bp, Homo sapiens
tgtgcaaatctatgcaaaactgatggt

SEQ ID NO: 31639 - DNA, 28 bp, Homo sapiens
tgtgcaaatctatgcaaaactgatggtg

SEQ ID NO: 31640 - DNA, 19 bp, Homo sapiens
taaagtgcttatagtgcag

SEQ ID NO: 31641 - DNA, 20 bp, Homo sapiens
taaagtgcttatagtgcagg

SEQ ID NO: 31642 - DNA, 21 bp, Homo sapiens
taaagtgcttatagtgcaggt

SEQ ID NO: 31643 - DNA, 22 bp, Homo sapiens
taaagtgcttatagtgcaggta

SEQ ID NO: 31644 - DNA, 24 bp, Homo sapiens
taaagtgcttatagtgcaggtagt

SEQ ID NO: 31645 - DNA, 25 bp, Homo sapiens
taaagtgcttatagtgcaggtagtg

SEQ ID NO: 31646 - DNA, 22 bp, Homo sapiens
aaagtgcttatagtgcaggtag

SEQ ID NO: 31647 - DNA, 18 bp, Homo sapiens
actgcattatgagcactt

SEQ ID NO: 31648 - DNA, 19 bp, Homo sapiens
actgcattatgagcactta

SEQ ID NO: 31649 - DNA, 20 bp, Homo sapiens
actgcattatgagcacttaa

SEQ ID NO: 31650 - DNA, 21 bp, Homo sapiens
actgcattatgagcacttaaa

SEQ ID NO: 31651 - DNA, 23 bp, Homo sapiens
actgcattatgagcacttaaagt

SEQ ID NO: 31652 - DNA, 24 bp, Homo sapiens
actgcattatgagcacttaaagta

SEQ ID NO: 31653 - DNA, 25 bp, Homo sapiens
actgcattatgagcacttaaagtac

SEQ ID NO: 31654 - DNA, 19 bp, Homo sapiens
ctgcattatgagcacttaa

SEQ ID NO: 31655 - DNA, 21 bp, Homo sapiens
ctgcattatgagcacttaaag

SEQ ID NO: 31656 - DNA, 22 bp, Homo sapiens
ctgcattatgagcacttaaagt

SEQ ID NO: 31657 - DNA, 24 bp, Homo sapiens
ctgcattatgagcacttaaagtac

SEQ ID NO: 31658 - DNA, 19 bp, Homo sapiens
agttttgcaggtttgcatc

SEQ ID NO: 31659 - DNA, 20 bp, Homo sapiens
agttttgcaggtttgcatcc

SEQ ID NO: 31660 - DNA, 21 bp, Homo sapiens
agttttgcaggtttgcatcca

SEQ ID NO: 31661 - DNA, 22 bp, Homo sapiens
agttttgcaggtttgcatccag

SEQ ID NO: 31662 - DNA, 24 bp, Homo sapiens
agttttgcaggtttgcatccagct

SEQ ID NO: 31663 - DNA, 28 bp, Homo sapiens
agttttgcaggtttgcatccagctgtgt

SEQ ID NO: 31664 - DNA, 18 bp, Homo sapiens
tgtgcaaatccatgcaaa

SEQ ID NO: 31665 - DNA, 21 bp, Homo sapiens
tgtgcaaatccatgcaaaact

SEQ ID NO: 31666 - DNA, 22 bp, Homo sapiens
tgtgcaaatccatgcaaaactg

SEQ ID NO: 31667 - DNA, 24 bp, Homo sapiens
tgtgcaaatccatgcaaaactgac

SEQ ID NO: 31668 - DNA, 25 bp, Homo sapiens
tgtgcaaatccatgcaaaactgact

SEQ ID NO: 31669 - DNA, 26 bp, Homo sapiens
tgtgcaaatccatgcaaaactgactg

SEQ ID NO: 31670 - DNA, 24 bp, Homo sapiens
gtgcaaatccatgcaaaactgact

SEQ ID NO: 31671 - DNA, 21 bp, Homo sapiens
caggttgggatcggttgcaat

SEQ ID NO: 31672 - DNA, 24 bp, Homo sapiens
caggttgggatcggttgcaatgct

SEQ ID NO: 31673 - DNA, 17 bp, Homo sapiens
aggttgggatcggttgc

SEQ ID NO: 31674 - DNA, 18 bp, Homo sapiens
aggttgggatcggttgca

SEQ ID NO: 31675 - DNA, 19 bp, Homo sapiens
aggttgggatcggttgcaa

SEQ ID NO: 31676 - DNA, 20 bp, Homo sapiens
aggttgggatcggttgcaat

SEQ ID NO: 31677 - DNA, 21 bp, Homo sapiens
aggttgggatcggttgcaatg

SEQ ID NO: 31678 - DNA, 22 bp, Homo sapiens
aggttgggatcggttgcaatgc

SEQ ID NO: 31679 - DNA, 24 bp, Homo sapiens
aggttgggatcggttgcaatgctg

SEQ ID NO: 31680 - DNA, 25 bp, Homo sapiens
aggttgggatcggttgcaatgctgt

SEQ ID NO: 31681 - DNA, 26 bp, Homo sapiens
aggttgggatcggttgcaatgctgtg

SEQ ID NO: 31682 - DNA, 27 bp, Homo sapiens
aggttgggatcggttgcaatgctgtgt

SEQ ID NO: 31683 - DNA, 22 bp, Homo sapiens
ggttgggatcggttgcaatgct

SEQ ID NO: 31684 - DNA, 23 bp, Homo sapiens
tattgcacttgtcccggcctgtt

SEQ ID NO: 31685 - DNA, 24 bp, Homo sapiens
tattgcacttgtcccggcctgttg

SEQ ID NO: 31686 - DNA, 25 bp, Homo sapiens
tattgcacttgtcccggcctgttga

SEQ ID NO: 31687 - DNA, 26 bp, Homo sapiens
tattgcacttgtcccggcctgttgag

SEQ ID NO: 31688 - DNA, 27 bp, Homo sapiens
tattgcacttgtcccggcctgttgagt

SEQ ID NO: 31689 - DNA, 22 bp, Homo sapiens
attgcacttgtcccggcctgtt

SEQ ID NO: 31690 - DNA, 21 bp, Homo sapiens
aagtaattgcgggttttgccg

SEQ ID NO: 31691 - DNA, 23 bp, Homo sapiens
gtaaaacccacaattatgtttgt

SEQ ID NO: 31692 - DNA, 20 bp, Homo sapiens
taaaacccacaattatgttt

SEQ ID NO: 31693 - DNA, 21 bp, Homo sapiens
taaaacccacaattatgtttg

SEQ ID NO: 31694 - DNA, 23 bp, Homo sapiens
taaaacccacaattatgtttgta

SEQ ID NO: 31695 - DNA, 25 bp, Homo sapiens
taaaacccacaattatgtttgtacc

SEQ ID NO: 31696 - DNA, 21 bp, Homo sapiens
aaaacccacaattatgtttgt

SEQ ID NO: 31697 - DNA, 17 bp, Homo sapiens
tatgtgacctcggatga

SEQ ID NO: 31698 - DNA, 18 bp, Homo sapiens
tatgtgacctcggatgaa

SEQ ID NO: 31699 - DNA, 19 bp, Homo sapiens
tatgtgacctcggatgaat

SEQ ID NO: 31700 - DNA, 20 bp, Homo sapiens
tatgtgacctcggatgaatc

SEQ ID NO: 31701 - DNA, 23 bp, Homo sapiens
tatgtgacctcggatgaatcact

SEQ ID NO: 31702 - DNA, 16 bp, Homo sapiens
gtaacactggggttct

SEQ ID NO: 31703 - DNA, 19 bp, Homo sapiens
gtaacactggggttctgag

SEQ ID NO: 31704 - DNA, 22 bp, Homo sapiens
actggggttctgagacagacag

SEQ ID NO: 31705 - DNA, 23 bp, Homo sapiens
actggggttctgagacagacagt

SEQ ID NO: 31706 - DNA, 25 bp, Homo sapiens
actggggttctgagacagacagtgt

SEQ ID NO: 31707 - DNA, 20 bp, Homo sapiens
ctggggttctgagacagaca

SEQ ID NO: 31708 - DNA, 21 bp, Homo sapiens
ctggggttctgagacagacag

SEQ ID NO: 31709 - DNA, 24 bp, Homo sapiens
ctggggttctgagacagacagtgt

SEQ ID NO: 31710 - DNA, 21 bp, Homo sapiens
tggggttctgagacagacagt

SEQ ID NO: 31711 - DNA, 23 bp, Homo sapiens
tggggttctgagacagacagtgt

SEQ ID NO: 31712 - DNA, 20 bp, Homo sapiens
ggggttctgagacagacagt

SEQ ID NO: 31713 - DNA, 19 bp, Homo sapiens
gggttctgagacagacagt

SEQ ID NO: 31714 - DNA, 24 bp, Homo sapiens
tcgaggagctcacagtctagacaa

SEQ ID NO: 31715 - DNA, 23 bp, Homo sapiens
tcgaggagctcacagtctagaca

SEQ ID NO: 31716 - DNA, 22 bp, Homo sapiens
tcgaggagctcacagtctagac

SEQ ID NO: 31717 - DNA, 23 bp, Homo sapiens
ctcgaggagctcacagtctagac

SEQ ID NO: 31718 - DNA, 21 bp, Homo sapiens
tcgaggagctcacagtctaga

SEQ ID NO: 31719 - DNA, 22 bp, Homo sapiens
ctcgaggagctcacagtctaga

SEQ ID NO: 31720 - DNA, 17 bp, Homo sapiens
aggggtgctatctgtga

SEQ ID NO: 31721 - DNA, 19 bp, Homo sapiens
aggggtgctatctgtgatt

SEQ ID NO: 31722 - DNA, 20 bp, Homo sapiens
aggggtgctatctgtgattg

SEQ ID NO: 31723 - DNA, 22 bp, Homo sapiens
aggggtgctatctgtgattgag

SEQ ID NO: 31724 - DNA, 23 bp, Homo sapiens
aggggtgctatctgtgattgagg

SEQ ID NO: 31725 - DNA, 24 bp, Homo sapiens
aggggtgctatctgtgattgaggg

SEQ ID NO: 31726 - DNA, 25 bp, Homo sapiens
aggggtgctatctgtgattgaggga

SEQ ID NO: 31727 - DNA, 26 bp, Homo sapiens
aggggtgctatctgtgattgagggac

SEQ ID NO: 31728 - DNA, 27 bp, Homo sapiens
aggggtgctatctgtgattgagggaca

SEQ ID NO: 31729 - DNA, 18 bp, Homo sapiens
ggggtgctatctgtgatt

SEQ ID NO: 31730 - DNA, 20 bp, Homo sapiens
ggggtgctatctgtgattga

SEQ ID NO: 31731 - DNA, 22 bp, Homo sapiens
ggggtgctatctgtgattgagg

SEQ ID NO: 31732 - DNA, 23 bp, Homo sapiens
ggggtgctatctgtgattgaggg

SEQ ID NO: 31733 - DNA, 24 bp, Homo sapiens
ggggtgctatctgtgattgaggga

SEQ ID NO: 31734 - DNA, 25 bp, Homo sapiens
ggggtgctatctgtgattgagggac

SEQ ID NO: 31735 - DNA, 26 bp, Homo sapiens
ggggtgctatctgtgattgagggaca

SEQ ID NO: 31736 - DNA, 22 bp, Homo sapiens
tgctatctgtgattgagggaca

SEQ ID NO: 31737 - DNA, 18 bp, Homo sapiens
tctcacacagaaatcgca

SEQ ID NO: 31738 - DNA, 19 bp, Homo sapiens
tctcacacagaaatcgcac

SEQ ID NO: 31739 - DNA, 20 bp, Homo sapiens
tctcacacagaaatcgcacc

SEQ ID NO: 31740 - DNA, 21 bp, Homo sapiens
tctcacacagaaatcgcaccc

SEQ ID NO: 31741 - DNA, 22 bp, Homo sapiens
tctcacacagaaatcgcacccg

SEQ ID NO: 31742 - DNA, 24 bp, Homo sapiens
tctcacacagaaatcgcacccgtc

SEQ ID NO: 31743 - DNA, 25 bp, Homo sapiens
tctcacacagaaatcgcacccgtca

SEQ ID NO: 31744 - DNA, 27 bp, Homo sapiens
tctcacacagaaatcgcacccgtcacc

SEQ ID NO: 31745 - DNA, 23 bp, Homo sapiens
tcacacagaaatcgcacccgtca

SEQ ID NO: 31746 - DNA, 25 bp, Homo sapiens
tcacacagaaatcgcacccgtcacc

SEQ ID NO: 31747 - DNA, 22 bp, Homo sapiens
ctcccagggtctggtcagagtt

SEQ ID NO: 31748 - DNA, 23 bp, Homo sapiens
ctcccagggtctggtcagagttg

SEQ ID NO: 31749 - DNA, 20 bp, Homo sapiens
tcccagggtctggtcagagt

SEQ ID NO: 31750 - DNA, 21 bp, Homo sapiens
tcccagggtctggtcagagtt

SEQ ID NO: 31751 - DNA, 23 bp, Homo sapiens
tcccagggtctggtcagagttgc

SEQ ID NO: 31752 - DNA, 19 bp, Homo sapiens
cccagggtctggtcagagt

SEQ ID NO: 31753 - DNA, 21 bp, Homo sapiens
cccagggtctggtcagagttg

SEQ ID NO: 31754 - DNA, 20 bp, Homo sapiens
ccagggtctggtcagagttg

SEQ ID NO: 31755 - DNA, 19 bp, Homo sapiens
ggttgatctctggtctttc

SEQ ID NO: 31756 - DNA, 19 bp, Homo sapiens
tctctggtctttccttgac

SEQ ID NO: 31757 - DNA, 20 bp, Homo sapiens
tctctggtctttccttgaca

SEQ ID NO: 31758 - DNA, 22 bp, Homo sapiens
tctctggtctttccttgacagt

SEQ ID NO: 31759 - DNA, 23 bp, Homo sapiens
tctctggtctttccttgacagtg

SEQ ID NO: 31760 - DNA, 17 bp, Homo sapiens
tggtctttccttgacag

SEQ ID NO: 31761 - DNA, 17 bp, Homo sapiens
gctgactcctagtccag

SEQ ID NO: 31762 - DNA, 18 bp, Homo sapiens
gctgactcctagtccagg

SEQ ID NO: 31763 - DNA, 19 bp, Homo sapiens
gctgactcctagtccaggg

SEQ ID NO: 31764 - DNA, 20 bp, Homo sapiens
gctgactcctagtccagggc

SEQ ID NO: 31765 - DNA, 21 bp, Homo sapiens
gctgactcctagtccagggct

SEQ ID NO: 31766 - DNA, 23 bp, Homo sapiens
gctgactcctagtccagggctcg

SEQ ID NO: 31767 - DNA, 24 bp, Homo sapiens
gctgactcctagtccagggctcgt

SEQ ID NO: 31768 - DNA, 28 bp, Homo sapiens
gctgactcctagtccagggctcgtgatg

SEQ ID NO: 31769 - DNA, 19 bp, Homo sapiens
gccctgaacgaggggtctg

SEQ ID NO: 31770 - DNA, 21 bp, Homo sapiens
gccctgaacgaggggtctgga

SEQ ID NO: 31771 - DNA, 23 bp, Homo sapiens
gccctgaacgaggggtctggagg

SEQ ID NO: 31772 - DNA, 24 bp, Homo sapiens
gccctgaacgaggggtctggaggc

SEQ ID NO: 31773 - DNA, 17 bp, Homo sapiens
ccctgaacgaggggtct

SEQ ID NO: 31774 - DNA, 18 bp, Homo sapiens
ccctgaacgaggggtctg

SEQ ID NO: 31775 - DNA, 20 bp, Homo sapiens
ccctgaacgaggggtctgga

SEQ ID NO: 31776 - DNA, 21 bp, Homo sapiens
ccctgaacgaggggtctggag

SEQ ID NO: 31777 - DNA, 22 bp, Homo sapiens
ccctgaacgaggggtctggagg

SEQ ID NO: 31778 - DNA, 20 bp, Homo sapiens
cctgaacgaggggtctggag

SEQ ID NO: 31779 - DNA, 21 bp, Homo sapiens
cctgaacgaggggtctggagg

SEQ ID NO: 31780 - DNA, 18 bp, Homo sapiens
ctgaacgaggggtctgga

SEQ ID NO: 31781 - DNA, 18 bp, Homo sapiens
taggatgggggtgagagg

SEQ ID NO: 31782 - DNA, 19 bp, Homo sapiens
taggatgggggtgagaggt

SEQ ID NO: 31783 - DNA, 21 bp, Homo sapiens
taggatgggggtgagaggtgc

SEQ ID NO: 31784 - DNA, 20 bp, Homo sapiens
tccagtaccacgtgtcaggg

SEQ ID NO: 31785 - DNA, 21 bp, Homo sapiens
tccagtaccacgtgtcagggc

SEQ ID NO: 31786 - DNA, 22 bp, Homo sapiens
tccagtaccacgtgtcagggcc

SEQ ID NO: 31787 - DNA, 24 bp, Homo sapiens
tccagtaccacgtgtcagggccac

SEQ ID NO: 31788 - DNA, 25 bp, Homo sapiens
tccagtaccacgtgtcagggccaca

SEQ ID NO: 31789 - DNA, 26 bp, Homo sapiens
tccagtaccacgtgtcagggccacat

SEQ ID NO: 31790 - DNA, 27 bp, Homo sapiens
tccagtaccacgtgtcagggccacatg

SEQ ID NO: 31791 - DNA, 18 bp, Homo sapiens
ttgtacatggtaggcttt

SEQ ID NO: 31792 - DNA, 19 bp, Homo sapiens
ttgtacatggtaggctttc

SEQ ID NO: 31793 - DNA, 20 bp, Homo sapiens
ttgtacatggtaggctttca

SEQ ID NO: 31794 - DNA, 21 bp, Homo sapiens
ttgtacatggtaggctttcat

SEQ ID NO: 31795 - DNA, 23 bp, Homo sapiens
ttgtacatggtaggctttcattc

SEQ ID NO: 31796 - DNA, 24 bp, Homo sapiens
ttgtacatggtaggctttcattca

SEQ ID NO: 31797 - DNA, 25 bp, Homo sapiens
ttgtacatggtaggctttcattcat

SEQ ID NO: 31798 - DNA, 26 bp, Homo sapiens
ttgtacatggtaggctttcattcatt

SEQ ID NO: 31799 - DNA, 21 bp, Homo sapiens
tgtacatggtaggctttcatt

SEQ ID NO: 31800 - DNA, 20 bp, Homo sapiens
tgaaggtctactgtgtgcca

SEQ ID NO: 31801 - DNA, 21 bp, Homo sapiens
tgaaggtctactgtgtgccag

SEQ ID NO: 31802 - DNA, 23 bp, Homo sapiens
tgaaggtctactgtgtgccaggc

SEQ ID NO: 31803 - DNA, 24 bp, Homo sapiens
tgaaggtctactgtgtgccaggcc

SEQ ID NO: 31804 - DNA, 25 bp, Homo sapiens
tgaaggtctactgtgtgccaggccc

SEQ ID NO: 31805 - DNA, 19 bp, Homo sapiens
gaaggtctactgtgtgcca

SEQ ID NO: 31806 - DNA, 20 bp, Homo sapiens
gaaggtctactgtgtgccag

SEQ ID NO: 31807 - DNA, 16 bp, Homo sapiens
gggtgggaacggcttc

SEQ ID NO: 31808 - DNA, 17 bp, Homo sapiens
gaacggcttcatacagg

SEQ ID NO: 31809 - DNA, 18 bp, Homo sapiens
gaacggcttcatacagga

SEQ ID NO: 31810 - DNA, 19 bp, Homo sapiens
gaacggcttcatacaggag

SEQ ID NO: 31811 - DNA, 20 bp, Homo sapiens
gaacggcttcatacaggagt

SEQ ID NO: 31812 - DNA, 22 bp, Homo sapiens
gaacggcttcatacaggagttg

SEQ ID NO: 31813 - DNA, 23 bp, Homo sapiens
gaacggcttcatacaggagttga

SEQ ID NO: 31814 - DNA, 23 bp, Homo sapiens
tccagctcctatatgatgccttt

SEQ ID NO: 31815 - DNA, 22 bp, Homo sapiens
ccagctcctatatgatgccttt

SEQ ID NO: 31816 - DNA, 20 bp, Homo sapiens
ctcctatatgatgcctttct

SEQ ID NO: 31817 - DNA, 21 bp, Homo sapiens
ctcctatatgatgcctttctt

SEQ ID NO: 31818 - DNA, 23 bp, Homo sapiens
ctcctatatgatgcctttcttca

SEQ ID NO: 31819 - DNA, 25 bp, Homo sapiens
ctcctatatgatgcctttcttcatc

SEQ ID NO: 31820 - DNA, 19 bp, Homo sapiens
tcctatatgatgcctttct

SEQ ID NO: 31821 - DNA, 20 bp, Homo sapiens
tcctatatgatgcctttctt

SEQ ID NO: 31822 - DNA, 21 bp, Homo sapiens
tcctatatgatgcctttcttc

SEQ ID NO: 31823 - DNA, 22 bp, Homo sapiens
tcctatatgatgcctttcttca

SEQ ID NO: 31824 - DNA, 24 bp, Homo sapiens
tcctatatgatgcctttcttcatc

SEQ ID NO: 31825 - DNA, 25 bp, Homo sapiens
tcctatatgatgcctttcttcatcc

SEQ ID NO: 31826 - DNA, 22 bp, Homo sapiens
ctatatgatgcctttcttcatc

SEQ ID NO: 31827 - DNA, 16 bp, Homo sapiens
ttcatgaccaggaggc

SEQ ID NO: 31828 - DNA, 19 bp, Homo sapiens
accaggaggctgaggcccc

SEQ ID NO: 31829 - DNA, 21 bp, Homo sapiens
accaggaggctgaggcccctc

SEQ ID NO: 31830 - DNA, 22 bp, Homo sapiens
accaggaggctgaggcccctca

SEQ ID NO: 31831 - DNA, 23 bp, Homo sapiens
accaggaggctgaggcccctcac

SEQ ID NO: 31832 - DNA, 24 bp, Homo sapiens
accaggaggctgaggcccctcaca

SEQ ID NO: 31833 - DNA, 25 bp, Homo sapiens
accaggaggctgaggcccctcacag

SEQ ID NO: 31834 - DNA, 26 bp, Homo sapiens
accaggaggctgaggcccctcacagg

SEQ ID NO: 31835 - DNA, 16 bp, Homo sapiens
tgtcttgcaggccgtc

SEQ ID NO: 31836 - DNA, 17 bp, Homo sapiens
tgtcttgcaggccgtca

SEQ ID NO: 31837 - DNA, 18 bp, Homo sapiens
tgtcttgcaggccgtcat

SEQ ID NO: 31838 - DNA, 19 bp, Homo sapiens
tgtcttgcaggccgtcatg

SEQ ID NO: 31839 - DNA, 20 bp, Homo sapiens
tgtcttgcaggccgtcatgc

SEQ ID NO: 31840 - DNA, 22 bp, Homo sapiens
tgtcttgcaggccgtcatgcag

SEQ ID NO: 31841 - DNA, 24 bp, Homo sapiens
tgtcttgcaggccgtcatgcaggc

SEQ ID NO: 31842 - DNA, 20 bp, Homo sapiens
gtcttgcaggccgtcatgca

SEQ ID NO: 31843 - DNA, 19 bp, Homo sapiens
ttgcaggtcgtcttgcagg

SEQ ID NO: 31844 - DNA, 20 bp, Homo sapiens
ttgcaggtcgtcttgcaggg

SEQ ID NO: 31845 - DNA, 21 bp, Homo sapiens
ttgcaggtcgtcttgcagggc

SEQ ID NO: 31846 - DNA, 22 bp, Homo sapiens
ttgcaggtcgtcttgcagggct

SEQ ID NO: 31847 - DNA, 24 bp, Homo sapiens
ttgcaggtcgtcttgcagggcttc

SEQ ID NO: 31848 - DNA, 25 bp, Homo sapiens
ttgcaggtcgtcttgcagggcttct

SEQ ID NO: 31849 - DNA, 26 bp, Homo sapiens
ttgcaggtcgtcttgcagggcttctc

SEQ ID NO: 31850 - DNA, 21 bp, Homo sapiens
tgcaggtcgtcttgcagggct

SEQ ID NO: 31851 - DNA, 23 bp, Homo sapiens
tgcaggtcgtcttgcagggcttc

SEQ ID NO: 31852 - DNA, 24 bp, Homo sapiens
tgcaggtcgtcttgcagggcttct

SEQ ID NO: 31853 - DNA, 25 bp, Homo sapiens
tgcaggtcgtcttgcagggcttctc

SEQ ID NO: 31854 - DNA, 28 bp, Homo sapiens
tgcaggtcgtcttgcagggcttctcgca

SEQ ID NO: 31855 - DNA, 16 bp, Homo sapiens
caggtcgtcttgcagg

SEQ ID NO: 31856 - DNA, 17 bp, Homo sapiens
caggtcgtcttgcaggg

SEQ ID NO: 31857 - DNA, 19 bp, Homo sapiens
caggtcgtcttgcagggct

SEQ ID NO: 31858 - DNA, 21 bp, Homo sapiens
caggtcgtcttgcagggcttc

SEQ ID NO: 31859 - DNA, 23 bp, Homo sapiens
caggtcgtcttgcagggcttctc

SEQ ID NO: 31860 - DNA, 24 bp, Homo sapiens
caggtcgtcttgcagggcttctcg

SEQ ID NO: 31861 - DNA, 25 bp, Homo sapiens
caggtcgtcttgcagggcttctcgc

SEQ ID NO: 31862 - DNA, 16 bp, Homo sapiens
tacggtgagcctgtca

SEQ ID NO: 31863 - DNA, 18 bp, Homo sapiens
tacggtgagcctgtcatt

SEQ ID NO: 31864 - DNA, 19 bp, Homo sapiens
tacggtgagcctgtcatta

SEQ ID NO: 31865 - DNA, 20 bp, Homo sapiens
tacggtgagcctgtcattat

SEQ ID NO: 31866 - DNA, 21 bp, Homo sapiens
tacggtgagcctgtcattatt

SEQ ID NO: 31867 - DNA, 23 bp, Homo sapiens
tacggtgagcctgtcattattca

SEQ ID NO: 31868 - DNA, 16 bp, Homo sapiens
gtgagcctgtcattat

SEQ ID NO: 31869 - DNA, 18 bp, Homo sapiens
gtgagcctgtcattattc

SEQ ID NO: 31870 - DNA, 16 bp, Homo sapiens
atcatgatgggctcct

SEQ ID NO: 31871 - DNA, 17 bp, Homo sapiens
atcatgatgggctcctc

SEQ ID NO: 31872 - DNA, 18 bp, Homo sapiens
atcatgatgggctcctcg

SEQ ID NO: 31873 - DNA, 19 bp, Homo sapiens
atcatgatgggctcctcgg

SEQ ID NO: 31874 - DNA, 20 bp, Homo sapiens
atcatgatgggctcctcggt

SEQ ID NO: 31875 - DNA, 21 bp, Homo sapiens
atcatgatgggctcctcggtg

SEQ ID NO: 31876 - DNA, 23 bp, Homo sapiens
atcatgatgggctcctcggtgtt

SEQ ID NO: 31877 - DNA, 24 bp, Homo sapiens
atcatgatgggctcctcggtgttc

SEQ ID NO: 31878 - DNA, 25 bp, Homo sapiens
atcatgatgggctcctcggtgttct

SEQ ID NO: 31879 - DNA, 26 bp, Homo sapiens
atcatgatgggctcctcggtgttctc

SEQ ID NO: 31880 - DNA, 27 bp, Homo sapiens
atcatgatgggctcctcggtgttctcc

SEQ ID NO: 31881 - DNA, 21 bp, Homo sapiens
tcatgatgggctcctcggtgt

SEQ ID NO: 31882 - DNA, 19 bp, Homo sapiens
atgatgggctcctcggtgt

SEQ ID NO: 31883 - DNA, 21 bp, Homo sapiens
tgctgaagctcagagggctct

SEQ ID NO: 31884 - DNA, 23 bp, Homo sapiens
tgctgaagctcagagggctctga

SEQ ID NO: 31885 - DNA, 26 bp, Homo sapiens
tgctgaagctcagagggctctgattc

SEQ ID NO: 31886 - DNA, 18 bp, Homo sapiens
ctgaagctcagagggctc

SEQ ID NO: 31887 - DNA, 19 bp, Homo sapiens
ctgaagctcagagggctct

SEQ ID NO: 31888 - DNA, 20 bp, Homo sapiens
ctgaagctcagagggctctg

SEQ ID NO: 31889 - DNA, 21 bp, Homo sapiens
ctgaagctcagagggctctga

SEQ ID NO: 31890 - DNA, 23 bp, Homo sapiens
ctgaagctcagagggctctgatt

SEQ ID NO: 31891 - DNA, 24 bp, Homo sapiens
ctgaagctcagagggctctgattc

SEQ ID NO: 31892 - DNA, 26 bp, Homo sapiens
ctgaagctcagagggctctgattcag

SEQ ID NO: 31893 - DNA, 27 bp, Homo sapiens
ctgaagctcagagggctctgattcaga

SEQ ID NO: 31894 - DNA, 20 bp, Homo sapiens
tgaagctcagagggctctga

SEQ ID NO: 31895 - DNA, 22 bp, Homo sapiens
tgaagctcagagggctctgatt

SEQ ID NO: 31896 - DNA, 23 bp, Homo sapiens
tgaagctcagagggctctgattc

SEQ ID NO: 31897 - DNA, 21 bp, Homo sapiens
gaagctcagagggctctgatt

SEQ ID NO: 31898 - DNA, 22 bp, Homo sapiens
gaagctcagagggctctgattc

SEQ ID NO: 31899 - DNA, 17 bp, Homo sapiens
tcggatccgtctgagct

SEQ ID NO: 31900 - DNA, 18 bp, Homo sapiens
tcggatccgtctgagctt

SEQ ID NO: 31901 - DNA, 19 bp, Homo sapiens
tcggatccgtctgagcttg

SEQ ID NO: 31902 - DNA, 20 bp, Homo sapiens
tcggatccgtctgagcttgg

SEQ ID NO: 31903 - DNA, 21 bp, Homo sapiens
tcggatccgtctgagcttggc

SEQ ID NO: 31904 - DNA, 23 bp, Homo sapiens
tcggatccgtctgagcttggctg

SEQ ID NO: 31905 - DNA, 24 bp, Homo sapiens
tcggatccgtctgagcttggctgg

SEQ ID NO: 31906 - DNA, 26 bp, Homo sapiens
tcggatccgtctgagcttggctggtc

SEQ ID NO: 31907 - DNA, 23 bp, Homo sapiens
cggatccgtctgagcttggctgg

SEQ ID NO: 31908 - DNA, 18 bp, Homo sapiens
tcttggagtaggtcattg

SEQ ID NO: 31909 - DNA, 19 bp, Homo sapiens
tcttggagtaggtcattgg

SEQ ID NO: 31910 - DNA, 20 bp, Homo sapiens
tcttggagtaggtcattggg

SEQ ID NO: 31911 - DNA, 21 bp, Homo sapiens
tcttggagtaggtcattgggt

SEQ ID NO: 31912 - DNA, 22 bp, Homo sapiens
tcttggagtaggtcattgggtg

SEQ ID NO: 31913 - DNA, 24 bp, Homo sapiens
tcttggagtaggtcattgggtgga

SEQ ID NO: 31914 - DNA, 25 bp, Homo sapiens
tcttggagtaggtcattgggtggat

SEQ ID NO: 31915 - DNA, 26 bp, Homo sapiens
tcttggagtaggtcattgggtggatc

SEQ ID NO: 31916 - DNA, 22 bp, Homo sapiens
gggccactggatggctcctcca

SEQ ID NO: 31917 - DNA, 17 bp, Homo sapiens
actggatggctcctcca

SEQ ID NO: 31918 - DNA, 20 bp, Homo sapiens
actggatggctcctccatgt

SEQ ID NO: 31919 - DNA, 21 bp, Homo sapiens
actggatggctcctccatgtc

SEQ ID NO: 31920 - DNA, 22 bp, Homo sapiens
actggatggctcctccatgtct

SEQ ID NO: 31921 - DNA, 23 bp, Homo sapiens
actggatggctcctccatgtctt

SEQ ID NO: 31922 - DNA, 18 bp, Homo sapiens
ctggatggctcctccatg

SEQ ID NO: 31923 - DNA, 19 bp, Homo sapiens
ctggatggctcctccatgt

SEQ ID NO: 31924 - DNA, 20 bp, Homo sapiens
ctggatggctcctccatgtc

SEQ ID NO: 31925 - DNA, 22 bp, Homo sapiens
ctggatggctcctccatgtctt

SEQ ID NO: 31926 - DNA, 23 bp, Homo sapiens
ctggatggctcctccatgtcttg

SEQ ID NO: 31927 - DNA, 20 bp, Homo sapiens
aggactccatttgttttgat

SEQ ID NO: 31928 - DNA, 22 bp, Homo sapiens
aggactccatttgttttgatga

SEQ ID NO: 31929 - DNA, 23 bp, Homo sapiens
aggactccatttgttttgatgat

SEQ ID NO: 31930 - DNA, 22 bp, Homo sapiens
ggactccatttgttttgatgat

SEQ ID NO: 31931 - DNA, 23 bp, Homo sapiens
ggactccatttgttttgatgatg

SEQ ID NO: 31932 - DNA, 21 bp, Homo sapiens
gactccatttgttttgatgat

SEQ ID NO: 31933 - DNA, 18 bp, Homo sapiens
actccatttgttttgatg

SEQ ID NO: 31934 - DNA, 19 bp, Homo sapiens
actccatttgttttgatga

SEQ ID NO: 31935 - DNA, 20 bp, Homo sapiens
actccatttgttttgatgat

SEQ ID NO: 31936 - DNA, 21 bp, Homo sapiens
actccatttgttttgatgatg

SEQ ID NO: 31937 - DNA, 22 bp, Homo sapiens
actccatttgttttgatgatgg

SEQ ID NO: 31938 - DNA, 24 bp, Homo sapiens
actccatttgttttgatgatggat

SEQ ID NO: 31939 - DNA, 25 bp, Homo sapiens
actccatttgttttgatgatggatt

SEQ ID NO: 31940 - DNA, 26 bp, Homo sapiens
actccatttgttttgatgatggattc

SEQ ID NO: 31941 - DNA, 17 bp, Homo sapiens
catcatcgtctcaaatg

SEQ ID NO: 31942 - DNA, 20 bp, Homo sapiens
catcatcgtctcaaatgagt

SEQ ID NO: 31943 - DNA, 21 bp, Homo sapiens
catcatcgtctcaaatgagtc

SEQ ID NO: 31944 - DNA, 23 bp, Homo sapiens
catcatcgtctcaaatgagtctt

SEQ ID NO: 31945 - DNA, 24 bp, Homo sapiens
catcatcgtctcaaatgagtcttc

SEQ ID NO: 31946 - DNA, 27 bp, Homo sapiens
catcatcgtctcaaatgagtcttcaga

SEQ ID NO: 31947 - DNA, 19 bp, Homo sapiens
atcatcgtctcaaatgagt

SEQ ID NO: 31948 - DNA, 20 bp, Homo sapiens
atcatcgtctcaaatgagtc

SEQ ID NO: 31949 - DNA, 21 bp, Homo sapiens
atcatcgtctcaaatgagtct

SEQ ID NO: 31950 - DNA, 22 bp, Homo sapiens
atcatcgtctcaaatgagtctt

SEQ ID NO: 31951 - DNA, 23 bp, Homo sapiens
atcatcgtctcaaatgagtcttc

SEQ ID NO: 31952 - DNA, 24 bp, Homo sapiens
atcatcgtctcaaatgagtcttca

SEQ ID NO: 31953 - DNA, 26 bp, Homo sapiens
atcatcgtctcaaatgagtcttcaga

SEQ ID NO: 31954 - DNA, 21 bp, Homo sapiens
tcatcgtctcaaatgagtctt

SEQ ID NO: 31955 - DNA, 22 bp, Homo sapiens
tcatcgtctcaaatgagtcttc

SEQ ID NO: 31956 - DNA, 22 bp, Homo sapiens
catcgtctcaaatgagtcttca

SEQ ID NO: 31957 - DNA, 17 bp, Homo sapiens
caaatgagtcttcagag

SEQ ID NO: 31958 - DNA, 22 bp, Homo sapiens
gaagccaggtcacgtctctgca

SEQ ID NO: 31959 - DNA, 22 bp, Homo sapiens
aagccaggtcacgtctctgcag

SEQ ID NO: 31960 - DNA, 19 bp, Homo sapiens
ccaggtcacgtctctgcag

SEQ ID NO: 31961 - DNA, 21 bp, Homo sapiens
ccaggtcacgtctctgcagtt

SEQ ID NO: 31962 - DNA, 22 bp, Homo sapiens
ccaggtcacgtctctgcagtta

SEQ ID NO: 31963 - DNA, 24 bp, Homo sapiens
ccaggtcacgtctctgcagttaca

SEQ ID NO: 31964 - DNA, 17 bp, Homo sapiens
caggtcacgtctctgca

SEQ ID NO: 31965 - DNA, 18 bp, Homo sapiens
caggtcacgtctctgcag

SEQ ID NO: 31966 - DNA, 19 bp, Homo sapiens
caggtcacgtctctgcagt

SEQ ID NO: 31967 - DNA, 20 bp, Homo sapiens
caggtcacgtctctgcagtt

SEQ ID NO: 31968 - DNA, 21 bp, Homo sapiens
caggtcacgtctctgcagtta

SEQ ID NO: 31969 - DNA, 23 bp, Homo sapiens
caggtcacgtctctgcagttaca

SEQ ID NO: 31970 - DNA, 24 bp, Homo sapiens
caggtcacgtctctgcagttacac

SEQ ID NO: 31971 - DNA, 25 bp, Homo sapiens
caggtcacgtctctgcagttacaca

SEQ ID NO: 31972 - DNA, 27 bp, Homo sapiens
caggtcacgtctctgcagttacacagc

SEQ ID NO: 31973 - DNA, 21 bp, Homo sapiens
tgcctgctggggtggaacctg

SEQ ID NO: 31974 - DNA, 18 bp, Homo sapiens
gcctgctggggtggaacc

SEQ ID NO: 31975 - DNA, 19 bp, Homo sapiens
gcctgctggggtggaacct

SEQ ID NO: 31976 - DNA, 20 bp, Homo sapiens
gcctgctggggtggaacctg

SEQ ID NO: 31977 - DNA, 21 bp, Homo sapiens
gcctgctggggtggaacctgg

SEQ ID NO: 31978 - DNA, 23 bp, Homo sapiens
gcctgctggggtggaacctggtc

SEQ ID NO: 31979 - DNA, 24 bp, Homo sapiens
gcctgctggggtggaacctggtct

SEQ ID NO: 31980 - DNA, 25 bp, Homo sapiens
gcctgctggggtggaacctggtctg

SEQ ID NO: 31981 - DNA, 26 bp, Homo sapiens
gcctgctggggtggaacctggtctgt

SEQ ID NO: 31982 - DNA, 22 bp, Homo sapiens
cctgctggggtggaacctggtc

SEQ ID NO: 31983 - DNA, 18 bp, Homo sapiens
tggtagactatggaacgt

SEQ ID NO: 31984 - DNA, 19 bp, Homo sapiens
tggtagactatggaacgta

SEQ ID NO: 31985 - DNA, 20 bp, Homo sapiens
tggtagactatggaacgtag

SEQ ID NO: 31986 - DNA, 22 bp, Homo sapiens
tggtagactatggaacgtaggc

SEQ ID NO: 31987 - DNA, 23 bp, Homo sapiens
tggtagactatggaacgtaggcg

SEQ ID NO: 31988 - DNA, 21 bp, Homo sapiens
ggtagactatggaacgtaggc

SEQ ID NO: 31989 - DNA, 17 bp, Homo sapiens
tatgtaacatggtccac

SEQ ID NO: 31990 - DNA, 18 bp, Homo sapiens
tatgtaacatggtccact

SEQ ID NO: 31991 - DNA, 19 bp, Homo sapiens
tatgtaacatggtccacta

SEQ ID NO: 31992 - DNA, 20 bp, Homo sapiens
tatgtaacatggtccactaa

SEQ ID NO: 31993 - DNA, 21 bp, Homo sapiens
tatgtaacatggtccactaac

SEQ ID NO: 31994 - DNA, 23 bp, Homo sapiens
tatgtaacatggtccactaactc

SEQ ID NO: 31995 - DNA, 24 bp, Homo sapiens
tatgtaacatggtccactaactct

SEQ ID NO: 31996 - DNA, 25 bp, Homo sapiens
tatgtaacatggtccactaactctc

SEQ ID NO: 31997 - DNA, 26 bp, Homo sapiens
tatgtaacatggtccactaactctca

SEQ ID NO: 31998 - DNA, 21 bp, Homo sapiens
atgtaacatggtccactaact

SEQ ID NO: 31999 - DNA, 22 bp, Homo sapiens
atgtaacatggtccactaactc

SEQ ID NO: 32000 - DNA, 21 bp, Homo sapiens
agagatagtagaccgtatagc

SEQ ID NO: 32001 - DNA, 22 bp, Homo sapiens
agagatagtagaccgtatagcg

SEQ ID NO: 32002 - DNA, 16 bp, Homo sapiens
atagtagaccgtatag

SEQ ID NO: 32003 - DNA, 17 bp, Homo sapiens
atagtagaccgtatagc

SEQ ID NO: 32004 - DNA, 19 bp, Homo sapiens
atagtagaccgtatagcgt

SEQ ID NO: 32005 - DNA, 20 bp, Homo sapiens
atagtagaccgtatagcgta

SEQ ID NO: 32006 - DNA, 21 bp, Homo sapiens
atagtagaccgtatagcgtac

SEQ ID NO: 32007 - DNA, 22 bp, Homo sapiens
atagtagaccgtatagcgtacg

SEQ ID NO: 32008 - DNA, 23 bp, Homo sapiens
atagtagaccgtatagcgtacgc

SEQ ID NO: 32009 - DNA, 17 bp, Homo sapiens
tagtagaccgtatagcg

SEQ ID NO: 32010 - DNA, 19 bp, Homo sapiens
tagtagaccgtatagcgta

SEQ ID NO: 32011 - DNA, 20 bp, Homo sapiens
tagtagaccgtatagcgtac

SEQ ID NO: 32012 - DNA, 22 bp, Homo sapiens
tagtagaccgtatagcgtacgc

SEQ ID NO: 32013 - DNA, 23 bp, Homo sapiens
tagtagaccgtatagcgtacgct

SEQ ID NO: 32014 - DNA, 16 bp, Homo sapiens
tagaccgtatagcgta

SEQ ID NO: 32015 - DNA, 17 bp, Homo sapiens
tagaccgtatagcgtac

SEQ ID NO: 32016 - DNA, 18 bp, Homo sapiens
tagaccgtatagcgtacg

SEQ ID NO: 32017 - DNA, 20 bp, Homo sapiens
tagaccgtatagcgtacgct

SEQ ID NO: 32018 - DNA, 20 bp, Homo sapiens
cgtatgtaacacggtccact

SEQ ID NO: 32019 - DNA, 21 bp, Homo sapiens
cgtatgtaacacggtccacta

SEQ ID NO: 32020 - DNA, 22 bp, Homo sapiens
cgtatgtaacacggtccactaa

SEQ ID NO: 32021 - DNA, 17 bp, Homo sapiens
tatgtaacacggtccac

SEQ ID NO: 32022 - DNA, 18 bp, Homo sapiens
tatgtaacacggtccact

SEQ ID NO: 32023 - DNA, 19 bp, Homo sapiens
tatgtaacacggtccacta

SEQ ID NO: 32024 - DNA, 20 bp, Homo sapiens
tatgtaacacggtccactaa

SEQ ID NO: 32025 - DNA, 21 bp, Homo sapiens
tatgtaacacggtccactaac

SEQ ID NO: 32026 - DNA, 25 bp, Homo sapiens
tatgtaacacggtccactaaccctc

SEQ ID NO: 32027 - DNA, 19 bp, Homo sapiens
atgtaacacggtccactaa

SEQ ID NO: 32028 - DNA, 19 bp, Homo sapiens
atggtttaccgtcccacat

SEQ ID NO: 32029 - DNA, 20 bp, Homo sapiens
atggtttaccgtcccacata

SEQ ID NO: 32030 - DNA, 21 bp, Homo sapiens
atggtttaccgtcccacatac

SEQ ID NO: 32031 - DNA, 22 bp, Homo sapiens
atggtttaccgtcccacataca

SEQ ID NO: 32032 - DNA, 24 bp, Homo sapiens
atggtttaccgtcccacatacatt

SEQ ID NO: 32033 - DNA, 19 bp, Homo sapiens
tggtttaccgtcccacata

SEQ ID NO: 32034 - DNA, 20 bp, Homo sapiens
tggtttaccgtcccacatac

SEQ ID NO: 32035 - DNA, 21 bp, Homo sapiens
tggtttaccgtcccacataca

SEQ ID NO: 32036 - DNA, 23 bp, Homo sapiens
tggtttaccgtcccacatacatt

SEQ ID NO: 32037 - DNA, 24 bp, Homo sapiens
tggtttaccgtcccacatacattt

SEQ ID NO: 32038 - DNA, 27 bp, Homo sapiens
tggtttaccgtcccacatacattttga

SEQ ID NO: 32039 - DNA, 25 bp, Homo sapiens
tgtatgtgggatggtaaaccgcttc

SEQ ID NO: 32040 - DNA, 18 bp, Homo sapiens
gtatgtgggatggtaaac

SEQ ID NO: 32041 - DNA, 21 bp, Homo sapiens
gtatgtgggatggtaaaccgc

SEQ ID NO: 32042 - DNA, 22 bp, Homo sapiens
gtatgtgggatggtaaaccgct

SEQ ID NO: 32043 - DNA, 24 bp, Homo sapiens
gtatgtgggatggtaaaccgcttc

SEQ ID NO: 32044 - DNA, 27 bp, Homo sapiens
gtatgtgggatggtaaaccgcttcttg

SEQ ID NO: 32045 - DNA, 17 bp, Homo sapiens
tatgtgggatggtaaac

SEQ ID NO: 32046 - DNA, 19 bp, Homo sapiens
tatgtgggatggtaaaccg

SEQ ID NO: 32047 - DNA, 20 bp, Homo sapiens
tatgtgggatggtaaaccgc

SEQ ID NO: 32048 - DNA, 21 bp, Homo sapiens
tatgtgggatggtaaaccgct

SEQ ID NO: 32049 - DNA, 23 bp, Homo sapiens
tatgtgggatggtaaaccgcttc

SEQ ID NO: 32050 - DNA, 26 bp, Homo sapiens
tatgtgggatggtaaaccgcttcttg

SEQ ID NO: 32051 - DNA, 17 bp, Homo sapiens
atggttgaccatagaac

SEQ ID NO: 32052 - DNA, 18 bp, Homo sapiens
atggttgaccatagaaca

SEQ ID NO: 32053 - DNA, 19 bp, Homo sapiens
atggttgaccatagaacat

SEQ ID NO: 32054 - DNA, 20 bp, Homo sapiens
atggttgaccatagaacatg

SEQ ID NO: 32055 - DNA, 21 bp, Homo sapiens
atggttgaccatagaacatgc

SEQ ID NO: 32056 - DNA, 22 bp, Homo sapiens
atggttgaccatagaacatgcg

SEQ ID NO: 32057 - DNA, 23 bp, Homo sapiens
atggttgaccatagaacatgcgc

SEQ ID NO: 32058 - DNA, 24 bp, Homo sapiens
atggttgaccatagaacatgcgct

SEQ ID NO: 32059 - DNA, 25 bp, Homo sapiens
atggttgaccatagaacatgcgcta

SEQ ID NO: 32060 - DNA, 17 bp, Homo sapiens
ggttgaccatagaacat

SEQ ID NO: 32061 - DNA, 18 bp, Homo sapiens
ggttgaccatagaacatg

SEQ ID NO: 32062 - DNA, 19 bp, Homo sapiens
ggttgaccatagaacatgc

SEQ ID NO: 32063 - DNA, 20 bp, Homo sapiens
ggttgaccatagaacatgcg

SEQ ID NO: 32064 - DNA, 21 bp, Homo sapiens
ggttgaccatagaacatgcgc

SEQ ID NO: 32065 - DNA, 20 bp, Homo sapiens
gttgaccatagaacatgcgc

SEQ ID NO: 32066 - DNA, 19 bp, Homo sapiens
ttgaccatagaacatgcgc

SEQ ID NO: 32067 - DNA, 18 bp, Homo sapiens
tgaccatagaacatgcgc

SEQ ID NO: 32068 - DNA, 17 bp, Homo sapiens
gaccatagaacatgcgc

SEQ ID NO: 32069 - DNA, 18 bp, Homo sapiens
tatgtaatatggtccaca

SEQ ID NO: 32070 - DNA, 19 bp, Homo sapiens
tatgtaatatggtccacat

SEQ ID NO: 32071 - DNA, 20 bp, Homo sapiens
tatgtaatatggtccacatc

SEQ ID NO: 32072 - DNA, 21 bp, Homo sapiens
tatgtaatatggtccacatct

SEQ ID NO: 32073 - DNA, 23 bp, Homo sapiens
tatgtaatatggtccacatcttc

SEQ ID NO: 32074 - DNA, 25 bp, Homo sapiens
tatgtaatatggtccacatcttctc

SEQ ID NO: 32075 - DNA, 26 bp, Homo sapiens
tatgtaatatggtccacatcttctca

SEQ ID NO: 32076 - DNA, 20 bp, Homo sapiens
atgtaatatggtccacatct

SEQ ID NO: 32077 - DNA, 21 bp, Homo sapiens
gtgacgtaggacacatggtct

SEQ ID NO: 32078 - DNA, 22 bp, Homo sapiens
gtgacgtaggacacatggtcta

SEQ ID NO: 32079 - DNA, 26 bp, Homo sapiens
gtgacgtaggacacatggtctacttc

SEQ ID NO: 32080 - DNA, 18 bp, Homo sapiens
taggacacatggtctact

SEQ ID NO: 32081 - DNA, 19 bp, Homo sapiens
taggacacatggtctactt

SEQ ID NO: 32082 - DNA, 20 bp, Homo sapiens
taggacacatggtctacttc

SEQ ID NO: 32083 - DNA, 22 bp, Homo sapiens
taggacacatggtctacttctt

SEQ ID NO: 32084 - DNA, 20 bp, Homo sapiens
aggacacatggtctacttct

SEQ ID NO: 32085 - DNA, 20 bp, Homo sapiens
gacacatggtctacttcttc

SEQ ID NO: 32086 - DNA, 21 bp, Homo sapiens
gacacatggtctacttcttct

SEQ ID NO: 32087 - DNA, 22 bp, Homo sapiens
gacacatggtctacttcttctc

SEQ ID NO: 32088 - DNA, 23 bp, Homo sapiens
gacacatggtctacttcttctca

SEQ ID NO: 32089 - DNA, 19 bp, Homo sapiens
aggtggtccgtggcgcgtt

SEQ ID NO: 32090 - DNA, 20 bp, Homo sapiens
aggtggtccgtggcgcgttc

SEQ ID NO: 32091 - DNA, 21 bp, Homo sapiens
aggtggtccgtggcgcgttcg

SEQ ID NO: 32092 - DNA, 23 bp, Homo sapiens
aggtggtccgtggcgcgttcgct

SEQ ID NO: 32093 - DNA, 24 bp, Homo sapiens
aggtggtccgtggcgcgttcgctt

SEQ ID NO: 32094 - DNA, 16 bp, Homo sapiens
gcgcgttcgctttatt

SEQ ID NO: 32095 - DNA, 17 bp, Homo sapiens
gcacattacacggtcga

SEQ ID NO: 32096 - DNA, 18 bp, Homo sapiens
gcacattacacggtcgac

SEQ ID NO: 32097 - DNA, 19 bp, Homo sapiens
gcacattacacggtcgacc

SEQ ID NO: 32098 - DNA, 20 bp, Homo sapiens
gcacattacacggtcgacct

SEQ ID NO: 32099 - DNA, 21 bp, Homo sapiens
gcacattacacggtcgacctc

SEQ ID NO: 32100 - DNA, 22 bp, Homo sapiens
gcacattacacggtcgacctct

SEQ ID NO: 32101 - DNA, 23 bp, Homo sapiens
gcacattacacggtcgacctctt

SEQ ID NO: 32102 - DNA, 24 bp, Homo sapiens
gcacattacacggtcgacctcttt

SEQ ID NO: 32103 - DNA, 19 bp, Homo sapiens
cacattacacggtcgacct

SEQ ID NO: 32104 - DNA, 20 bp, Homo sapiens
cacattacacggtcgacctc

SEQ ID NO: 32105 - DNA, 22 bp, Homo sapiens
cacattacacggtcgacctctt

SEQ ID NO: 32106 - DNA, 23 bp, Homo sapiens
cacattacacggtcgacctcttt

SEQ ID NO: 32107 - DNA, 19 bp, Homo sapiens
atggttgaccagagagcac

SEQ ID NO: 32108 - DNA, 20 bp, Homo sapiens
atggttgaccagagagcaca

SEQ ID NO: 32109 - DNA, 21 bp, Homo sapiens
atggttgaccagagagcacac

SEQ ID NO: 32110 - DNA, 22 bp, Homo sapiens
atggttgaccagagagcacacg

SEQ ID NO: 32111 - DNA, 23 bp, Homo sapiens
atggttgaccagagagcacacgc

SEQ ID NO: 32112 - DNA, 24 bp, Homo sapiens
atggttgaccagagagcacacgct

SEQ ID NO: 32113 - DNA, 25 bp, Homo sapiens
atggttgaccagagagcacacgctt

SEQ ID NO: 32114 - DNA, 21 bp, Homo sapiens
tggttgaccagagagcacacg

SEQ ID NO: 32115 - DNA, 17 bp, Homo sapiens
tttgtgacctggtccac

SEQ ID NO: 32116 - DNA, 19 bp, Homo sapiens
tttgtgacctggtccacta

SEQ ID NO: 32117 - DNA, 20 bp, Homo sapiens
tttgtgacctggtccactaa

SEQ ID NO: 32118 - DNA, 21 bp, Homo sapiens
tttgtgacctggtccactaac

SEQ ID NO: 32119 - DNA, 23 bp, Homo sapiens
tttgtgacctggtccactaaccc

SEQ ID NO: 32120 - DNA, 24 bp, Homo sapiens
tttgtgacctggtccactaaccct

SEQ ID NO: 32121 - DNA, 25 bp, Homo sapiens
tttgtgacctggtccactaaccctc

SEQ ID NO: 32122 - DNA, 20 bp, Homo sapiens
ttgtgacctggtccactaac

SEQ ID NO: 32123 - DNA, 21 bp, Homo sapiens
ttgtgacctggtccactaacc

SEQ ID NO: 32124 - DNA, 17 bp, Homo sapiens
ggacgaaacacacctgg

SEQ ID NO: 32125 - DNA, 22 bp, Homo sapiens
agaggttgtccgtgttgtcttc

SEQ ID NO: 32126 - DNA, 24 bp, Homo sapiens
agaggttgtccgtgttgtcttctc

SEQ ID NO: 32127 - DNA, 19 bp, Homo sapiens
aggttgtccgtgttgtctt

SEQ ID NO: 32128 - DNA, 21 bp, Homo sapiens
aggttgtccgtgttgtcttct

SEQ ID NO: 32129 - DNA, 22 bp, Homo sapiens
aggttgtccgtgttgtcttctc

SEQ ID NO: 32130 - DNA, 24 bp, Homo sapiens
aggttgtccgtgttgtcttctctt

SEQ ID NO: 32131 - DNA, 25 bp, Homo sapiens
aggttgtccgtgttgtcttctcttt

SEQ ID NO: 32132 - DNA, 26 bp, Homo sapiens
aggttgtccgtgttgtcttctcttta

SEQ ID NO: 32133 - DNA, 17 bp, Homo sapiens
tgaaacatacacgggaa

SEQ ID NO: 32134 - DNA, 18 bp, Homo sapiens
tgaaacatacacgggaaa

SEQ ID NO: 32135 - DNA, 21 bp, Homo sapiens
tgaaacatacacgggaaacct

SEQ ID NO: 32136 - DNA, 23 bp, Homo sapiens
tgaaacatacacgggaaacctct

SEQ ID NO: 32137 - DNA, 24 bp, Homo sapiens
tgaaacatacacgggaaacctctt

SEQ ID NO: 32138 - DNA, 25 bp, Homo sapiens
tgaaacatacacgggaaacctcttt

SEQ ID NO: 32139 - DNA, 26 bp, Homo sapiens
tgaaacatacacgggaaacctctttt

SEQ ID NO: 32140 - DNA, 19 bp, Homo sapiens
gaaacatacacgggaaacc

SEQ ID NO: 32141 - DNA, 22 bp, Homo sapiens
gaaacatacacgggaaacctct

SEQ ID NO: 32142 - DNA, 18 bp, Homo sapiens
gggatggtagaccggtga

SEQ ID NO: 32143 - DNA, 21 bp, Homo sapiens
gggatggtagaccggtgacgt

SEQ ID NO: 32144 - DNA, 22 bp, Homo sapiens
gggatggtagaccggtgacgtg

SEQ ID NO: 32145 - DNA, 24 bp, Homo sapiens
gggatggtagaccggtgacgtgca

SEQ ID NO: 32146 - DNA, 25 bp, Homo sapiens
gggatggtagaccggtgacgtgcac

SEQ ID NO: 32147 - DNA, 27 bp, Homo sapiens
gggatggtagaccggtgacgtgcactt

SEQ ID NO: 32148 - DNA, 22 bp, Homo sapiens
ggatggtagaccggtgacgtgc

SEQ ID NO: 32149 - DNA, 23 bp, Homo sapiens
ggatggtagaccggtgacgtgca

SEQ ID NO: 32150 - DNA, 21 bp, Homo sapiens
gatggtagaccggtgacgtgc

SEQ ID NO: 32151 - DNA, 20 bp, Homo sapiens
atggtagaccggtgacgtgc

SEQ ID NO: 32152 - DNA, 20 bp, Homo sapiens
tggtagaccggtgacgtgca

SEQ ID NO: 32153 - DNA, 16 bp, Homo sapiens
aaacattcgcggtgca

SEQ ID NO: 32154 - DNA, 20 bp, Homo sapiens
aaacattcgcggtgcacttc

SEQ ID NO: 32155 - DNA, 21 bp, Homo sapiens
aaacattcgcggtgcacttct

SEQ ID NO: 32156 - DNA, 23 bp, Homo sapiens
aaacattcgcggtgcacttcttt

SEQ ID NO: 32157 - DNA, 24 bp, Homo sapiens
aaacattcgcggtgcacttctttt

SEQ ID NO: 32158 - DNA, 25 bp, Homo sapiens
aaacattcgcggtgcacttcttttt

SEQ ID NO: 32159 - DNA, 26 bp, Homo sapiens
aaacattcgcggtgcacttctttttc

SEQ ID NO: 32160 - DNA, 28 bp, Homo sapiens
aaacattcgcggtgcacttctttttcag

SEQ ID NO: 32161 - DNA, 21 bp, Homo sapiens
aacattcgcggtgcacttctt

SEQ ID NO: 32162 - DNA, 22 bp, Homo sapiens
aacattcgcggtgcacttcttt

SEQ ID NO: 32163 - DNA, 19 bp, Homo sapiens
cattcgcggtgcacttctt

SEQ ID NO: 32164 - DNA, 18 bp, Homo sapiens
attcgcggtgcacttctt

SEQ ID NO: 32165 - DNA, 22 bp, Homo sapiens
agaagttgcccatgttattttc

SEQ ID NO: 32166 - DNA, 17 bp, Homo sapiens
gaagttgcccatgttat

SEQ ID NO: 32167 - DNA, 20 bp, Homo sapiens
gaagttgcccatgttatttt

SEQ ID NO: 32168 - DNA, 21 bp, Homo sapiens
gaagttgcccatgttattttc

SEQ ID NO: 32169 - DNA, 23 bp, Homo sapiens
gaagttgcccatgttattttcgc

SEQ ID NO: 32170 - DNA, 24 bp, Homo sapiens
gaagttgcccatgttattttcgct

SEQ ID NO: 32171 - DNA, 21 bp, Homo sapiens
aagttgcccatgttattttcg

SEQ ID NO: 32172 - DNA, 22 bp, Homo sapiens
aagttgcccatgttattttcgc

SEQ ID NO: 32173 - DNA, 18 bp, Homo sapiens
ttgcccatgttattttcg

SEQ ID NO: 32174 - DNA, 20 bp, Homo sapiens
aaacaaacatggtgcacttc

SEQ ID NO: 32175 - DNA, 21 bp, Homo sapiens
aaacaaacatggtgcacttct

SEQ ID NO: 32176 - DNA, 23 bp, Homo sapiens
aaacaaacatggtgcacttcttt

SEQ ID NO: 32177 - DNA, 24 bp, Homo sapiens
aaacaaacatggtgcacttctttt

SEQ ID NO: 32178 - DNA, 26 bp, Homo sapiens
aaacaaacatggtgcacttctttttc

SEQ ID NO: 32179 - DNA, 27 bp, Homo sapiens
aaacaaacatggtgcacttctttttcg

SEQ ID NO: 32180 - DNA, 28 bp, Homo sapiens
aaacaaacatggtgcacttctttttcgg

SEQ ID NO: 32181 - DNA, 21 bp, Homo sapiens
aacaaacatggtgcacttctt

SEQ ID NO: 32182 - DNA, 22 bp, Homo sapiens
aacaaacatggtgcacttcttt

SEQ ID NO: 32183 - DNA, 23 bp, Homo sapiens
aacaaacatggtgcacttctttt

SEQ ID NO: 32184 - DNA, 25 bp, Homo sapiens
aacaaacatggtgcacttctttttc

SEQ ID NO: 32185 - DNA, 27 bp, Homo sapiens
aacaaacatggtgcacttctttttcgg

SEQ ID NO: 32186 - DNA, 24 bp, Homo sapiens
acaaacatggtgcacttctttttc

SEQ ID NO: 32187 - DNA, 24 bp, Homo sapiens
aggtggatattccttctatgttta

SEQ ID NO: 32188 - DNA, 20 bp, Homo sapiens
ggtggatattccttctatgt

SEQ ID NO: 32189 - DNA, 22 bp, Homo sapiens
ggtggatattccttctatgttt

SEQ ID NO: 32190 - DNA, 23 bp, Homo sapiens
ggtggatattccttctatgttta

SEQ ID NO: 32191 - DNA, 25 bp, Homo sapiens
ggtggatattccttctatgtttatg

SEQ ID NO: 32192 - DNA, 23 bp, Homo sapiens
gtggatattccttctatgtttat

SEQ ID NO: 32193 - DNA, 24 bp, Homo sapiens
gtggatattccttctatgtttatg

SEQ ID NO: 32194 - DNA, 25 bp, Homo sapiens
gtggatattccttctatgtttatgt

SEQ ID NO: 32195 - DNA, 26 bp, Homo sapiens
gtggatattccttctatgtttatgtt

SEQ ID NO: 32196 - DNA, 22 bp, Homo sapiens
tggatattccttctatgtttat

SEQ ID NO: 32197 - DNA, 23 bp, Homo sapiens
tggatattccttctatgtttatg

SEQ ID NO: 32198 - DNA, 21 bp, Homo sapiens
ggatattccttctatgtttat

SEQ ID NO: 32199 - DNA, 22 bp, Homo sapiens
taaacatagaggaaattccacg

SEQ ID NO: 32200 - DNA, 21 bp, Homo sapiens
aaacatagaggaaattccacg

SEQ ID NO: 32201 - DNA, 18 bp, Homo sapiens
aacatagaggaaattcca

SEQ ID NO: 32202 - DNA, 19 bp, Homo sapiens
aacatagaggaaattccac

SEQ ID NO: 32203 - DNA, 20 bp, Homo sapiens
aacatagaggaaattccacg

SEQ ID NO: 32204 - DNA, 22 bp, Homo sapiens
aacatagaggaaattccacgtt

SEQ ID NO: 32205 - DNA, 23 bp, Homo sapiens
aacatagaggaaattccacgttt

SEQ ID NO: 32206 - DNA, 25 bp, Homo sapiens
aacatagaggaaattccacgttttc

SEQ ID NO: 32207 - DNA, 26 bp, Homo sapiens
aacatagaggaaattccacgttttca

SEQ ID NO: 32208 - DNA, 27 bp, Homo sapiens
aacatagaggaaattccacgttttcag

SEQ ID NO: 32209 - DNA, 21 bp, Homo sapiens
acatagaggaaattccacgtt

SEQ ID NO: 32210 - DNA, 24 bp, Homo sapiens
acatagaggaaattccacgttttc

SEQ ID NO: 32211 - DNA, 19 bp, Homo sapiens
catagaggaaattccacgt

SEQ ID NO: 32212 - DNA, 22 bp, Homo sapiens
ggtagattttccttctatggtt

SEQ ID NO: 32213 - DNA, 23 bp, Homo sapiens
ggtagattttccttctatggtta

SEQ ID NO: 32214 - DNA, 18 bp, Homo sapiens
gtagattttccttctatg

SEQ ID NO: 32215 - DNA, 19 bp, Homo sapiens
gtagattttccttctatgg

SEQ ID NO: 32216 - DNA, 20 bp, Homo sapiens
gtagattttccttctatggt

SEQ ID NO: 32217 - DNA, 21 bp, Homo sapiens
gtagattttccttctatggtt

SEQ ID NO: 32218 - DNA, 22 bp, Homo sapiens
gtagattttccttctatggtta

SEQ ID NO: 32219 - DNA, 23 bp, Homo sapiens
gtagattttccttctatggttac

SEQ ID NO: 32220 - DNA, 26 bp, Homo sapiens
gtagattttccttctatggttacgtg

SEQ ID NO: 32221 - DNA, 27 bp, Homo sapiens
tggttaatcatagaggaaaatccacgt

SEQ ID NO: 32222 - DNA, 26 bp, Homo sapiens
ggttaatcatagaggaaaatccacgt

SEQ ID NO: 32223 - DNA, 25 bp, Homo sapiens
gttaatcatagaggaaaatccacgt

SEQ ID NO: 32224 - DNA, 21 bp, Homo sapiens
aatcatagaggaaaatccacg

SEQ ID NO: 32225 - DNA, 22 bp, Homo sapiens
atcatagaggaaaatccacgtt

SEQ ID NO: 32226 - DNA, 25 bp, Homo sapiens
agatggtgggccgcagaacatgtgc

SEQ ID NO: 32227 - DNA, 20 bp, Homo sapiens
gatggtgggccgcagaacat

SEQ ID NO: 32228 - DNA, 16 bp, Homo sapiens
atggtgggccgcagaa

SEQ ID NO: 32229 - DNA, 17 bp, Homo sapiens
atggtgggccgcagaac

SEQ ID NO: 32230 - DNA, 18 bp, Homo sapiens
atggtgggccgcagaaca

SEQ ID NO: 32231 - DNA, 19 bp, Homo sapiens
atggtgggccgcagaacat

SEQ ID NO: 32232 - DNA, 20 bp, Homo sapiens
atggtgggccgcagaacatg

SEQ ID NO: 32233 - DNA, 21 bp, Homo sapiens
atggtgggccgcagaacatgt

SEQ ID NO: 32234 - DNA, 22 bp, Homo sapiens
atggtgggccgcagaacatgtg

SEQ ID NO: 32235 - DNA, 23 bp, Homo sapiens
atggtgggccgcagaacatgtgc

SEQ ID NO: 32236 - DNA, 25 bp, Homo sapiens
atggtgggccgcagaacatgtgctg

SEQ ID NO: 32237 - DNA, 16 bp, Homo sapiens
tggtgggccgcagaac

SEQ ID NO: 32238 - DNA, 18 bp, Homo sapiens
tggtgggccgcagaacat

SEQ ID NO: 32239 - DNA, 19 bp, Homo sapiens
tggtgggccgcagaacatg

SEQ ID NO: 32240 - DNA, 20 bp, Homo sapiens
tggtgggccgcagaacatgt

SEQ ID NO: 32241 - DNA, 21 bp, Homo sapiens
tggtgggccgcagaacatgtg

SEQ ID NO: 32242 - DNA, 23 bp, Homo sapiens
tggtgggccgcagaacatgtgct

SEQ ID NO: 32243 - DNA, 24 bp, Homo sapiens
tggtgggccgcagaacatgtgctg

SEQ ID NO: 32244 - DNA, 25 bp, Homo sapiens
tggtgggccgcagaacatgtgctga

SEQ ID NO: 32245 - DNA, 27 bp, Homo sapiens
tggtgggccgcagaacatgtgctgagt

SEQ ID NO: 32246 - DNA, 20 bp, Homo sapiens
ggccgcagaacatgtgctga

SEQ ID NO: 32247 - DNA, 22 bp, Homo sapiens
catatgtctgctgaccatcacc

SEQ ID NO: 32248 - DNA, 20 bp, Homo sapiens
tatgtctgctgaccatcacc

SEQ ID NO: 32249 - DNA, 21 bp, Homo sapiens
tatgtctgctgaccatcacct

SEQ ID NO: 32250 - DNA, 23 bp, Homo sapiens
tatgtctgctgaccatcaccttt

SEQ ID NO: 32251 - DNA, 24 bp, Homo sapiens
tatgtctgctgaccatcaccttta

SEQ ID NO: 32252 - DNA, 25 bp, Homo sapiens
tatgtctgctgaccatcacctttag

SEQ ID NO: 32253 - DNA, 19 bp, Homo sapiens
atgtctgctgaccatcacc

SEQ ID NO: 32254 - DNA, 22 bp, Homo sapiens
aacgtggatattccttctatgt

SEQ ID NO: 32255 - DNA, 23 bp, Homo sapiens
aacgtggatattccttctatgtt

SEQ ID NO: 32256 - DNA, 23 bp, Homo sapiens
gtggatattccttctatgtttac

SEQ ID NO: 32257 - DNA, 24 bp, Homo sapiens
gtggatattccttctatgtttacg

SEQ ID NO: 32258 - DNA, 25 bp, Homo sapiens
gtggatattccttctatgtttacgt

SEQ ID NO: 32259 - DNA, 26 bp, Homo sapiens
gtggatattccttctatgtttacgtg

SEQ ID NO: 32260 - DNA, 27 bp, Homo sapiens
gtggatattccttctatgtttacgtga

SEQ ID NO: 32261 - DNA, 22 bp, Homo sapiens
tggatattccttctatgtttac

SEQ ID NO: 32262 - DNA, 23 bp, Homo sapiens
tggatattccttctatgtttacg

SEQ ID NO: 32263 - DNA, 19 bp, Homo sapiens
atcatagaggaaaatccat

SEQ ID NO: 32264 - DNA, 20 bp, Homo sapiens
atcatagaggaaaatccatg

SEQ ID NO: 32265 - DNA, 21 bp, Homo sapiens
atcatagaggaaaatccatgt

SEQ ID NO: 32266 - DNA, 23 bp, Homo sapiens
atcatagaggaaaatccatgttt

SEQ ID NO: 32267 - DNA, 24 bp, Homo sapiens
atcatagaggaaaatccatgtttt

SEQ ID NO: 32268 - DNA, 25 bp, Homo sapiens
atcatagaggaaaatccatgttttc

SEQ ID NO: 32269 - DNA, 27 bp, Homo sapiens
atcatagaggaaaatccatgttttcag

SEQ ID NO: 32270 - DNA, 28 bp, Homo sapiens
atcatagaggaaaatccatgttttcagt

SEQ ID NO: 32271 - DNA, 20 bp, Homo sapiens
tcatagaggaaaatccatgt

SEQ ID NO: 32272 - DNA, 21 bp, Homo sapiens
tcatagaggaaaatccatgtt

SEQ ID NO: 32273 - DNA, 24 bp, Homo sapiens
tcatagaggaaaatccatgttttc

SEQ ID NO: 32274 - DNA, 18 bp, Homo sapiens
atagaggaaaatccatgt

SEQ ID NO: 32275 - DNA, 22 bp, Homo sapiens
atagaggaaaatccatgttttc

SEQ ID NO: 32276 - DNA, 22 bp, Homo sapiens
aggtagattctccttctatgag

SEQ ID NO: 32277 - DNA, 23 bp, Homo sapiens
aggtagattctccttctatgagt

SEQ ID NO: 32278 - DNA, 22 bp, Homo sapiens
ggtagattctccttctatgagt

SEQ ID NO: 32279 - DNA, 18 bp, Homo sapiens
gtagattctccttctatg

SEQ ID NO: 32280 - DNA, 19 bp, Homo sapiens
gtagattctccttctatga

SEQ ID NO: 32281 - DNA, 20 bp, Homo sapiens
gtagattctccttctatgag

SEQ ID NO: 32282 - DNA, 21 bp, Homo sapiens
gtagattctccttctatgagt

SEQ ID NO: 32283 - DNA, 23 bp, Homo sapiens
gtagattctccttctatgagtac

SEQ ID NO: 32284 - DNA, 24 bp, Homo sapiens
gtagattctccttctatgagtaca

SEQ ID NO: 32285 - DNA, 26 bp, Homo sapiens
gtagattctccttctatgagtacatt

SEQ ID NO: 32286 - DNA, 22 bp, Homo sapiens
tagattctccttctatgagtac

SEQ ID NO: 32287 - DNA, 22 bp, Homo sapiens
attctccttctatgagtacatt

SEQ ID NO: 32288 - DNA, 27 bp, Homo sapiens
tgattaatcatagaggaaaatccacgt

SEQ ID NO: 32289 - DNA, 26 bp, Homo sapiens
gattaatcatagaggaaaatccacgt

SEQ ID NO: 32290 - DNA, 24 bp, Homo sapiens
attaatcatagaggaaaatccacg

SEQ ID NO: 32291 - DNA, 25 bp, Homo sapiens
attaatcatagaggaaaatccacgt

SEQ ID NO: 32292 - DNA, 22 bp, Homo sapiens
atcatagaggaaaatccacgtt

SEQ ID NO: 32293 - DNA, 16 bp, Homo sapiens
tatacaagggcagact

SEQ ID NO: 32294 - DNA, 17 bp, Homo sapiens
tatacaagggcagactc

SEQ ID NO: 32295 - DNA, 23 bp, Homo sapiens
tatacaagggcagactctctctg

SEQ ID NO: 32296 - DNA, 23 bp, Homo sapiens
aatatacagggggagactcttat

SEQ ID NO: 32297 - DNA, 24 bp, Homo sapiens
aatatacagggggagactcttatt

SEQ ID NO: 32298 - DNA, 25 bp, Homo sapiens
aatatacagggggagactcttattt

SEQ ID NO: 32299 - DNA, 20 bp, Homo sapiens
atatacagggggagactctt

SEQ ID NO: 32300 - DNA, 21 bp, Homo sapiens
atatacagggggagactctta

SEQ ID NO: 32301 - DNA, 23 bp, Homo sapiens
atatacagggggagactcttatt

SEQ ID NO: 32302 - DNA, 24 bp, Homo sapiens
atatacagggggagactcttattt

SEQ ID NO: 32303 - DNA, 25 bp, Homo sapiens
atatacagggggagactcttatttg

SEQ ID NO: 32304 - DNA, 26 bp, Homo sapiens
atatacagggggagactcttatttgc

SEQ ID NO: 32305 - DNA, 27 bp, Homo sapiens
atatacagggggagactcttatttgcg

SEQ ID NO: 32306 - DNA, 21 bp, Homo sapiens
tatacagggggagactcttat

SEQ ID NO: 32307 - DNA, 23 bp, Homo sapiens
tatacagggggagactcttattt

SEQ ID NO: 32308 - DNA, 25 bp, Homo sapiens
aaagagaggataccctttgtatgtt

SEQ ID NO: 32309 - DNA, 24 bp, Homo sapiens
aatatacagggggagactctcatt

SEQ ID NO: 32310 - DNA, 20 bp, Homo sapiens
atatacagggggagactctc

SEQ ID NO: 32311 - DNA, 21 bp, Homo sapiens
atatacagggggagactctca

SEQ ID NO: 32312 - DNA, 23 bp, Homo sapiens
atatacagggggagactctcatt

SEQ ID NO: 32313 - DNA, 24 bp, Homo sapiens
atatacagggggagactctcattt

SEQ ID NO: 32314 - DNA, 25 bp, Homo sapiens
atatacagggggagactctcatttg

SEQ ID NO: 32315 - DNA, 27 bp, Homo sapiens
atatacagggggagactctcatttgcg

SEQ ID NO: 32316 - DNA, 21 bp, Homo sapiens
tatacagggggagactctcat

SEQ ID NO: 32317 - DNA, 23 bp, Homo sapiens
tatacagggggagactctcattt

SEQ ID NO: 32318 - DNA, 16 bp, Homo sapiens
agcgaggttgcccttt

SEQ ID NO: 32319 - DNA, 17 bp, Homo sapiens
agcgaggttgccctttg

SEQ ID NO: 32320 - DNA, 18 bp, Homo sapiens
agcgaggttgccctttgt

SEQ ID NO: 32321 - DNA, 19 bp, Homo sapiens
agcgaggttgccctttgta

SEQ ID NO: 32322 - DNA, 20 bp, Homo sapiens
agcgaggttgccctttgtat

SEQ ID NO: 32323 - DNA, 21 bp, Homo sapiens
agcgaggttgccctttgtata

SEQ ID NO: 32324 - DNA, 23 bp, Homo sapiens
agcgaggttgccctttgtatatt

SEQ ID NO: 32325 - DNA, 24 bp, Homo sapiens
agcgaggttgccctttgtatattc

SEQ ID NO: 32326 - DNA, 25 bp, Homo sapiens
agcgaggttgccctttgtatattcg

SEQ ID NO: 32327 - DNA, 27 bp, Homo sapiens
agcgaggttgccctttgtatattcggt

SEQ ID NO: 32328 - DNA, 23 bp, Homo sapiens
cgaggttgccctttgtatattcg

SEQ ID NO: 32329 - DNA, 20 bp, Homo sapiens
atatacaagggcaagctctc

SEQ ID NO: 32330 - DNA, 21 bp, Homo sapiens
atatacaagggcaagctctct

SEQ ID NO: 32331 - DNA, 23 bp, Homo sapiens
atatacaagggcaagctctctgt

SEQ ID NO: 32332 - DNA, 16 bp, Homo sapiens
tatacaagggcaagct

SEQ ID NO: 32333 - DNA, 19 bp, Homo sapiens
tatacaagggcaagctctc

SEQ ID NO: 32334 - DNA, 20 bp, Homo sapiens
tatacaagggcaagctctct

SEQ ID NO: 32335 - DNA, 21 bp, Homo sapiens
tatacaagggcaagctctctg

SEQ ID NO: 32336 - DNA, 23 bp, Homo sapiens
tatacaagggcaagctctctgtg

SEQ ID NO: 32337 - DNA, 21 bp, Homo sapiens
atacaagggcaagctctctgt

SEQ ID NO: 32338 - DNA, 19 bp, Homo sapiens
acaagggcaagctctctgt

SEQ ID NO: 32339 - DNA, 22 bp, Homo sapiens
agagtggttatccctgtcctgt

SEQ ID NO: 32340 - DNA, 24 bp, Homo sapiens
agagtggttatccctgtcctgttc

SEQ ID NO: 32341 - DNA, 20 bp, Homo sapiens
agtggttatccctgtcctgt

SEQ ID NO: 32342 - DNA, 21 bp, Homo sapiens
agtggttatccctgtcctgtt

SEQ ID NO: 32343 - DNA, 22 bp, Homo sapiens
agtggttatccctgtcctgttc

SEQ ID NO: 32344 - DNA, 23 bp, Homo sapiens
agtggttatccctgtcctgttcg

SEQ ID NO: 32345 - DNA, 19 bp, Homo sapiens
gtggttatccctgtcctgt

SEQ ID NO: 32346 - DNA, 20 bp, Homo sapiens
gtggttatccctgtcctgtt

SEQ ID NO: 32347 - DNA, 21 bp, Homo sapiens
gtggttatccctgtcctgttc

SEQ ID NO: 32348 - DNA, 23 bp, Homo sapiens
gtggttatccctgtcctgttcgt

SEQ ID NO: 32349 - DNA, 24 bp, Homo sapiens
gtggttatccctgtcctgttcgtt

SEQ ID NO: 32350 - DNA, 21 bp, Homo sapiens
tggttatccctgtcctgttcg

SEQ ID NO: 32351 - DNA, 16 bp, Homo sapiens
aatcgtacagggtcat

SEQ ID NO: 32352 - DNA, 19 bp, Homo sapiens
aatcgtacagggtcatcca

SEQ ID NO: 32353 - DNA, 20 bp, Homo sapiens
aatcgtacagggtcatccac

SEQ ID NO: 32354 - DNA, 21 bp, Homo sapiens
aatcgtacagggtcatccact

SEQ ID NO: 32355 - DNA, 23 bp, Homo sapiens
aatcgtacagggtcatccacttt

SEQ ID NO: 32356 - DNA, 24 bp, Homo sapiens
aatcgtacagggtcatccactttt

SEQ ID NO: 32357 - DNA, 25 bp, Homo sapiens
aatcgtacagggtcatccacttttt

SEQ ID NO: 32358 - DNA, 26 bp, Homo sapiens
aatcgtacagggtcatccactttttc

SEQ ID NO: 32359 - DNA, 22 bp, Homo sapiens
atcgtacagggtcatccacttt

SEQ ID NO: 32360 - DNA, 25 bp, Homo sapiens
atcgtacagggtcatccactttttc

SEQ ID NO: 32361 - DNA, 19 bp, Homo sapiens
tcgtacagggtcatccact

SEQ ID NO: 32362 - DNA, 20 bp, Homo sapiens
tcgtacagggtcatccactt

SEQ ID NO: 32363 - DNA, 21 bp, Homo sapiens
tcgtacagggtcatccacttt

SEQ ID NO: 32364 - DNA, 22 bp, Homo sapiens
tcgtacagggtcatccactttt

SEQ ID NO: 32365 - DNA, 23 bp, Homo sapiens
tcgtacagggtcatccacttttt

SEQ ID NO: 32366 - DNA, 24 bp, Homo sapiens
tcgtacagggtcatccactttttc

SEQ ID NO: 32367 - DNA, 26 bp, Homo sapiens
tcgtacagggtcatccactttttcag

SEQ ID NO: 32368 - DNA, 17 bp, Homo sapiens
ggagaaattatccttgg

SEQ ID NO: 32369 - DNA, 19 bp, Homo sapiens
ggagaaattatccttggtg

SEQ ID NO: 32370 - DNA, 20 bp, Homo sapiens
ggagaaattatccttggtgt

SEQ ID NO: 32371 - DNA, 21 bp, Homo sapiens
ggagaaattatccttggtgtg

SEQ ID NO: 32372 - DNA, 23 bp, Homo sapiens
ggagaaattatccttggtgtgtt

SEQ ID NO: 32373 - DNA, 24 bp, Homo sapiens
ggagaaattatccttggtgtgttc

SEQ ID NO: 32374 - DNA, 27 bp, Homo sapiens
ggagaaattatccttggtgtgttcgct

SEQ ID NO: 32375 - DNA, 18 bp, Homo sapiens
agaaattatccttggtgt

SEQ ID NO: 32376 - DNA, 21 bp, Homo sapiens
agaaattatccttggtgtgtt

SEQ ID NO: 32377 - DNA, 22 bp, Homo sapiens
agaaattatccttggtgtgttc

SEQ ID NO: 32378 - DNA, 21 bp, Homo sapiens
aatcatacaaggacaatttct

SEQ ID NO: 32379 - DNA, 23 bp, Homo sapiens
aatcatacaaggacaatttcttt

SEQ ID NO: 32380 - DNA, 25 bp, Homo sapiens
aatcatacaaggacaatttcttttt

SEQ ID NO: 32381 - DNA, 18 bp, Homo sapiens
atcatacaaggacaattt

SEQ ID NO: 32382 - DNA, 19 bp, Homo sapiens
atcatacaaggacaatttc

SEQ ID NO: 32383 - DNA, 20 bp, Homo sapiens
atcatacaaggacaatttct

SEQ ID NO: 32384 - DNA, 21 bp, Homo sapiens
atcatacaaggacaatttctt

SEQ ID NO: 32385 - DNA, 23 bp, Homo sapiens
atcatacaaggacaatttctttt

SEQ ID NO: 32386 - DNA, 24 bp, Homo sapiens
atcatacaaggacaatttcttttt

SEQ ID NO: 32387 - DNA, 25 bp, Homo sapiens
atcatacaaggacaatttctttttg

SEQ ID NO: 32388 - DNA, 27 bp, Homo sapiens
atcatacaaggacaatttctttttgag

SEQ ID NO: 32389 - DNA, 18 bp, Homo sapiens
catacaaggacaatttct

SEQ ID NO: 32390 - DNA, 21 bp, Homo sapiens
catacaaggacaatttctttt

SEQ ID NO: 32391 - DNA, 22 bp, Homo sapiens
catacaaggacaatttcttttt

SEQ ID NO: 32392 - DNA, 24 bp, Homo sapiens
catacaaggacaatttctttttga

SEQ ID NO: 32393 - DNA, 18 bp, Homo sapiens
atacaaggacaatttctt

SEQ ID NO: 32394 - DNA, 21 bp, Homo sapiens
atacaaggacaatttcttttt

SEQ ID NO: 32395 - DNA, 22 bp, Homo sapiens
atacaaggacaatttctttttg

SEQ ID NO: 32396 - DNA, 23 bp, Homo sapiens
atacaaggacaatttctttttga

SEQ ID NO: 32397 - DNA, 23 bp, Homo sapiens
gaatggctgtccgtagtatggtc

SEQ ID NO: 32398 - DNA, 25 bp, Homo sapiens
gaatggctgtccgtagtatggtctc

SEQ ID NO: 32399 - DNA, 20 bp, Homo sapiens
aatggctgtccgtagtatgg

SEQ ID NO: 32400 - DNA, 21 bp, Homo sapiens
aatggctgtccgtagtatggt

SEQ ID NO: 32401 - DNA, 23 bp, Homo sapiens
aatggctgtccgtagtatggtct

SEQ ID NO: 32402 - DNA, 24 bp, Homo sapiens
aatggctgtccgtagtatggtctc

SEQ ID NO: 32403 - DNA, 25 bp, Homo sapiens
aatggctgtccgtagtatggtctct

SEQ ID NO: 32404 - DNA, 23 bp, Homo sapiens
atggctgtccgtagtatggtctc

SEQ ID NO: 32405 - DNA, 16 bp, Homo sapiens
ttaatatcggacaacc

SEQ ID NO: 32406 - DNA, 17 bp, Homo sapiens
ttaatatcggacaacca

SEQ ID NO: 32407 - DNA, 18 bp, Homo sapiens
ttaatatcggacaaccat

SEQ ID NO: 32408 - DNA, 19 bp, Homo sapiens
ttaatatcggacaaccatt

SEQ ID NO: 32409 - DNA, 20 bp, Homo sapiens
ttaatatcggacaaccattg

SEQ ID NO: 32410 - DNA, 22 bp, Homo sapiens
ttaatatcggacaaccattgtt

SEQ ID NO: 32411 - DNA, 23 bp, Homo sapiens
ttaatatcggacaaccattgttt

SEQ ID NO: 32412 - DNA, 24 bp, Homo sapiens
ttaatatcggacaaccattgtttt

SEQ ID NO: 32413 - DNA, 26 bp, Homo sapiens
ttaatatcggacaaccattgttttag

SEQ ID NO: 32414 - DNA, 20 bp, Homo sapiens
accaagattctgcattttta

SEQ ID NO: 32415 - DNA, 22 bp, Homo sapiens
accaagattctgcatttttagc

SEQ ID NO: 32416 - DNA, 21 bp, Homo sapiens
attctgcatttttagcaagtt

SEQ ID NO: 32417 - DNA, 26 bp, Homo sapiens
attctgcatttttagcaagttctcaa

SEQ ID NO: 32418 - DNA, 24 bp, Homo sapiens
tgcatttttagcaagttctcaagt

SEQ ID NO: 32419 - DNA, 18 bp, Homo sapiens
agaggttatccgtgttat

SEQ ID NO: 32420 - DNA, 20 bp, Homo sapiens
agaggttatccgtgttatgt

SEQ ID NO: 32421 - DNA, 21 bp, Homo sapiens
agaggttatccgtgttatgtt

SEQ ID NO: 32422 - DNA, 23 bp, Homo sapiens
agaggttatccgtgttatgttcg

SEQ ID NO: 32423 - DNA, 24 bp, Homo sapiens
agaggttatccgtgttatgttcgc

SEQ ID NO: 32424 - DNA, 18 bp, Homo sapiens
gaataatacatggttaac

SEQ ID NO: 32425 - DNA, 19 bp, Homo sapiens
ataatacatggttaacctc

SEQ ID NO: 32426 - DNA, 20 bp, Homo sapiens
ataatacatggttaacctct

SEQ ID NO: 32427 - DNA, 21 bp, Homo sapiens
ataatacatggttaacctctt

SEQ ID NO: 32428 - DNA, 23 bp, Homo sapiens
ataatacatggttaacctctttt

SEQ ID NO: 32429 - DNA, 24 bp, Homo sapiens
ataatacatggttaacctcttttt

SEQ ID NO: 32430 - DNA, 17 bp, Homo sapiens
gtggttatccctgctgt

SEQ ID NO: 32431 - DNA, 18 bp, Homo sapiens
gtggttatccctgctgtg

SEQ ID NO: 32432 - DNA, 19 bp, Homo sapiens
gtggttatccctgctgtgt

SEQ ID NO: 32433 - DNA, 20 bp, Homo sapiens
gtggttatccctgctgtgtt

SEQ ID NO: 32434 - DNA, 21 bp, Homo sapiens
gtggttatccctgctgtgttc

SEQ ID NO: 32435 - DNA, 23 bp, Homo sapiens
gtggttatccctgctgtgttcgc

SEQ ID NO: 32436 - DNA, 24 bp, Homo sapiens
gtggttatccctgctgtgttcgct

SEQ ID NO: 32437 - DNA, 25 bp, Homo sapiens
gtggttatccctgctgtgttcgctt

SEQ ID NO: 32438 - DNA, 26 bp, Homo sapiens
gtggttatccctgctgtgttcgctta

SEQ ID NO: 32439 - DNA, 18 bp, Homo sapiens
aatcatacagggacatcc

SEQ ID NO: 32440 - DNA, 19 bp, Homo sapiens
aatcatacagggacatcca

SEQ ID NO: 32441 - DNA, 20 bp, Homo sapiens
aatcatacagggacatccag

SEQ ID NO: 32442 - DNA, 21 bp, Homo sapiens
aatcatacagggacatccagt

SEQ ID NO: 32443 - DNA, 23 bp, Homo sapiens
aatcatacagggacatccagttt

SEQ ID NO: 32444 - DNA, 24 bp, Homo sapiens
aatcatacagggacatccagtttt

SEQ ID NO: 32445 - DNA, 26 bp, Homo sapiens
aatcatacagggacatccagtttttc

SEQ ID NO: 32446 - DNA, 28 bp, Homo sapiens
aatcatacagggacatccagtttttcag

SEQ ID NO: 32447 - DNA, 22 bp, Homo sapiens
atcatacagggacatccagttt

SEQ ID NO: 32448 - DNA, 25 bp, Homo sapiens
atcatacagggacatccagtttttc

SEQ ID NO: 32449 - DNA, 16 bp, Homo sapiens
gaagttgttcgtggtg

SEQ ID NO: 32450 - DNA, 19 bp, Homo sapiens
gaagttgttcgtggtggat

SEQ ID NO: 32451 - DNA, 20 bp, Homo sapiens
gaagttgttcgtggtggatt

SEQ ID NO: 32452 - DNA, 21 bp, Homo sapiens
gaagttgttcgtggtggattc

SEQ ID NO: 32453 - DNA, 23 bp, Homo sapiens
gaagttgttcgtggtggattcgc

SEQ ID NO: 32454 - DNA, 24 bp, Homo sapiens
gaagttgttcgtggtggattcgct

SEQ ID NO: 32455 - DNA, 25 bp, Homo sapiens
gaagttgttcgtggtggattcgctt

SEQ ID NO: 32456 - DNA, 18 bp, Homo sapiens
aagttgttcgtggtggat

SEQ ID NO: 32457 - DNA, 21 bp, Homo sapiens
aagttgttcgtggtggattcg

SEQ ID NO: 32458 - DNA, 23 bp, Homo sapiens
aagttgttcgtggtggattcgct

SEQ ID NO: 32459 - DNA, 18 bp, Homo sapiens
agttgttcgtggtggatt

SEQ ID NO: 32460 - DNA, 21 bp, Homo sapiens
agttgttcgtggtggattcgc

SEQ ID NO: 32461 - DNA, 22 bp, Homo sapiens
agttgttcgtggtggattcgct

SEQ ID NO: 32462 - DNA, 26 bp, Homo sapiens
agttgttcgtggtggattcgctttac

SEQ ID NO: 32463 - DNA, 22 bp, Homo sapiens
cgaatcattcacggacaacact

SEQ ID NO: 32464 - DNA, 23 bp, Homo sapiens
cgaatcattcacggacaacactt

SEQ ID NO: 32465 - DNA, 16 bp, Homo sapiens
aatcattcacggacaa

SEQ ID NO: 32466 - DNA, 18 bp, Homo sapiens
aatcattcacggacaaca

SEQ ID NO: 32467 - DNA, 19 bp, Homo sapiens
aatcattcacggacaacac

SEQ ID NO: 32468 - DNA, 20 bp, Homo sapiens
aatcattcacggacaacact

SEQ ID NO: 32469 - DNA, 22 bp, Homo sapiens
aatcattcacggacaacacttt

SEQ ID NO: 32470 - DNA, 23 bp, Homo sapiens
aatcattcacggacaacactttt

SEQ ID NO: 32471 - DNA, 24 bp, Homo sapiens
aatcattcacggacaacacttttt

SEQ ID NO: 32472 - DNA, 26 bp, Homo sapiens
aatcattcacggacaacacttttttc

SEQ ID NO: 32473 - DNA, 27 bp, Homo sapiens
aatcattcacggacaacacttttttca

SEQ ID NO: 32474 - DNA, 19 bp, Homo sapiens
atcattcacggacaacact

SEQ ID NO: 32475 - DNA, 21 bp, Homo sapiens
atcattcacggacaacacttt

SEQ ID NO: 32476 - DNA, 22 bp, Homo sapiens
tcattcacggacaacacttttt

SEQ ID NO: 32477 - DNA, 17 bp, Homo sapiens
tgtgactggttgaccag

SEQ ID NO: 32478 - DNA, 18 bp, Homo sapiens
tgtgactggttgaccaga

SEQ ID NO: 32479 - DNA, 19 bp, Homo sapiens
tgtgactggttgaccagag

SEQ ID NO: 32480 - DNA, 20 bp, Homo sapiens
tgtgactggttgaccagagg

SEQ ID NO: 32481 - DNA, 21 bp, Homo sapiens
tgtgactggttgaccagaggg

SEQ ID NO: 32482 - DNA, 23 bp, Homo sapiens
tgtgactggttgaccagaggggc

SEQ ID NO: 32483 - DNA, 24 bp, Homo sapiens
tgtgactggttgaccagaggggca

SEQ ID NO: 32484 - DNA, 25 bp, Homo sapiens
tgtgactggttgaccagaggggcat

SEQ ID NO: 32485 - DNA, 26 bp, Homo sapiens
tgtgactggttgaccagaggggcatg

SEQ ID NO: 32486 - DNA, 22 bp, Homo sapiens
cctgtgggccacctagtcacca

SEQ ID NO: 32487 - DNA, 24 bp, Homo sapiens
cctgtgggccacctagtcaccaac

SEQ ID NO: 32488 - DNA, 20 bp, Homo sapiens
ctgtgggccacctagtcacc

SEQ ID NO: 32489 - DNA, 21 bp, Homo sapiens
ctgtgggccacctagtcacca

SEQ ID NO: 32490 - DNA, 22 bp, Homo sapiens
ctgtgggccacctagtcaccaa

SEQ ID NO: 32491 - DNA, 23 bp, Homo sapiens
ctgtgggccacctagtcaccaac

SEQ ID NO: 32492 - DNA, 24 bp, Homo sapiens
ctgtgggccacctagtcaccaacc

SEQ ID NO: 32493 - DNA, 20 bp, Homo sapiens
tgtgggccacctagtcacca

SEQ ID NO: 32494 - DNA, 22 bp, Homo sapiens
tgtgggccacctagtcaccaac

SEQ ID NO: 32495 - DNA, 23 bp, Homo sapiens
tgtgggccacctagtcaccaacc

SEQ ID NO: 32496 - DNA, 20 bp, Homo sapiens
gtaagtgcgcctcgggtgag

SEQ ID NO: 32497 - DNA, 22 bp, Homo sapiens
gtaagtgcgcctcgggtgagca

SEQ ID NO: 32498 - DNA, 23 bp, Homo sapiens
gtaagtgcgcctcgggtgagcat

SEQ ID NO: 32499 - DNA, 24 bp, Homo sapiens
gtaagtgcgcctcgggtgagcatg

SEQ ID NO: 32500 - DNA, 25 bp, Homo sapiens
gtaagtgcgcctcgggtgagcatgc

SEQ ID NO: 32501 - DNA, 24 bp, Homo sapiens
taagtgcgcctcgggtgagcatgc

SEQ ID NO: 32502 - DNA, 22 bp, Homo sapiens
agtgcgcctcgggtgagcatgc

SEQ ID NO: 32503 - DNA, 24 bp, Homo sapiens
agtgcgcctcgggtgagcatgcac

SEQ ID NO: 32504 - DNA, 16 bp, Homo sapiens
gcgcctcgggtgagca

SEQ ID NO: 32505 - DNA, 24 bp, Homo sapiens
gcgcctcgggtgagcatgcactta

SEQ ID NO: 32506 - DNA, 22 bp, Homo sapiens
cgcctcgggtgagcatgcactt

SEQ ID NO: 32507 - DNA, 23 bp, Homo sapiens
cgcctcgggtgagcatgcactta

SEQ ID NO: 32508 - DNA, 17 bp, Homo sapiens
gggtgagcatgcactta

SEQ ID NO: 32509 - DNA, 16 bp, Homo sapiens
ggtgtatgtcactcgg

SEQ ID NO: 32510 - DNA, 20 bp, Homo sapiens
tatgtcactcggctcggccc

SEQ ID NO: 32511 - DNA, 21 bp, Homo sapiens
tatgtcactcggctcggccca

SEQ ID NO: 32512 - DNA, 23 bp, Homo sapiens
tatgtcactcggctcggcccact

SEQ ID NO: 32513 - DNA, 26 bp, Homo sapiens
tatgtcactcggctcggcccactacc

SEQ ID NO: 32514 - DNA, 21 bp, Homo sapiens
atgtcactcggctcggcccac

SEQ ID NO: 32515 - DNA, 22 bp, Homo sapiens
atgtcactcggctcggcccact

SEQ ID NO: 32516 - DNA, 23 bp, Homo sapiens
atgtcactcggctcggcccacta

SEQ ID NO: 32517 - DNA, 24 bp, Homo sapiens
atgtcactcggctcggcccactac

SEQ ID NO: 32518 - DNA, 25 bp, Homo sapiens
atgtcactcggctcggcccactacc

SEQ ID NO: 32519 - DNA, 18 bp, Homo sapiens
tgtcactcggctcggccc

SEQ ID NO: 32520 - DNA, 21 bp, Homo sapiens
tgtcactcggctcggcccact

SEQ ID NO: 32521 - DNA, 22 bp, Homo sapiens
tgtcactcggctcggcccacta

SEQ ID NO: 32522 - DNA, 24 bp, Homo sapiens
tgtcactcggctcggcccactacc

SEQ ID NO: 32523 - DNA, 25 bp, Homo sapiens
tgtcactcggctcggcccactaccc

SEQ ID NO: 32524 - DNA, 17 bp, Homo sapiens
agaggctggccgtgatg

SEQ ID NO: 32525 - DNA, 18 bp, Homo sapiens
agaggctggccgtgatga

SEQ ID NO: 32526 - DNA, 19 bp, Homo sapiens
agaggctggccgtgatgaa

SEQ ID NO: 32527 - DNA, 20 bp, Homo sapiens
agaggctggccgtgatgaat

SEQ ID NO: 32528 - DNA, 21 bp, Homo sapiens
agaggctggccgtgatgaatt

SEQ ID NO: 32529 - DNA, 23 bp, Homo sapiens
agaggctggccgtgatgaattcg

SEQ ID NO: 32530 - DNA, 24 bp, Homo sapiens
agaggctggccgtgatgaattcga

SEQ ID NO: 32531 - DNA, 25 bp, Homo sapiens
agaggctggccgtgatgaattcgat

SEQ ID NO: 32532 - DNA, 26 bp, Homo sapiens
agaggctggccgtgatgaattcgatt

SEQ ID NO: 32533 - DNA, 27 bp, Homo sapiens
agaggctggccgtgatgaattcgattc

SEQ ID NO: 32534 - DNA, 24 bp, Homo sapiens
gagtcatacacggctctcctctct

SEQ ID NO: 32535 - DNA, 19 bp, Homo sapiens
agtcatacacggctctcct

SEQ ID NO: 32536 - DNA, 21 bp, Homo sapiens
agtcatacacggctctcctct

SEQ ID NO: 32537 - DNA, 22 bp, Homo sapiens
agtcatacacggctctcctctc

SEQ ID NO: 32538 - DNA, 23 bp, Homo sapiens
agtcatacacggctctcctctct

SEQ ID NO: 32539 - DNA, 24 bp, Homo sapiens
agtcatacacggctctcctctctt

SEQ ID NO: 32540 - DNA, 26 bp, Homo sapiens
agtcatacacggctctcctctctttt

SEQ ID NO: 32541 - DNA, 17 bp, Homo sapiens
gtcatacacggctctcc

SEQ ID NO: 32542 - DNA, 18 bp, Homo sapiens
gtcatacacggctctcct

SEQ ID NO: 32543 - DNA, 19 bp, Homo sapiens
gtcatacacggctctcctc

SEQ ID NO: 32544 - DNA, 20 bp, Homo sapiens
gtcatacacggctctcctct

SEQ ID NO: 32545 - DNA, 21 bp, Homo sapiens
gtcatacacggctctcctctc

SEQ ID NO: 32546 - DNA, 23 bp, Homo sapiens
gtcatacacggctctcctctctt

SEQ ID NO: 32547 - DNA, 24 bp, Homo sapiens
gtcatacacggctctcctctcttt

SEQ ID NO: 32548 - DNA, 27 bp, Homo sapiens
gtcatacacggctctcctctcttttag

SEQ ID NO: 32549 - DNA, 22 bp, Homo sapiens
catacacggctctcctctcttt

SEQ ID NO: 32550 - DNA, 22 bp, Homo sapiens
gaggttgtccgtggtgagttcg

SEQ ID NO: 32551 - DNA, 17 bp, Homo sapiens
aggttgtccgtggtgag

SEQ ID NO: 32552 - DNA, 18 bp, Homo sapiens
aggttgtccgtggtgagt

SEQ ID NO: 32553 - DNA, 19 bp, Homo sapiens
aggttgtccgtggtgagtt

SEQ ID NO: 32554 - DNA, 21 bp, Homo sapiens
aggttgtccgtggtgagttcg

SEQ ID NO: 32555 - DNA, 22 bp, Homo sapiens
aggttgtccgtggtgagttcgc

SEQ ID NO: 32556 - DNA, 24 bp, Homo sapiens
aggttgtccgtggtgagttcgcat

SEQ ID NO: 32557 - DNA, 25 bp, Homo sapiens
aggttgtccgtggtgagttcgcatt

SEQ ID NO: 32558 - DNA, 26 bp, Homo sapiens
aggttgtccgtggtgagttcgcatta

SEQ ID NO: 32559 - DNA, 16 bp, Homo sapiens
cccaatacacggtcga

SEQ ID NO: 32560 - DNA, 17 bp, Homo sapiens
cccaatacacggtcgac

SEQ ID NO: 32561 - DNA, 18 bp, Homo sapiens
cccaatacacggtcgacc

SEQ ID NO: 32562 - DNA, 19 bp, Homo sapiens
cccaatacacggtcgacct

SEQ ID NO: 32563 - DNA, 20 bp, Homo sapiens
cccaatacacggtcgacctc

SEQ ID NO: 32564 - DNA, 21 bp, Homo sapiens
cccaatacacggtcgacctct

SEQ ID NO: 32565 - DNA, 23 bp, Homo sapiens
cccaatacacggtcgacctcttt

SEQ ID NO: 32566 - DNA, 25 bp, Homo sapiens
cccaatacacggtcgacctcttttc

SEQ ID NO: 32567 - DNA, 23 bp, Homo sapiens
ataggttatccgtgttgccttcg

SEQ ID NO: 32568 - DNA, 17 bp, Homo sapiens
taggttatccgtgttgc

SEQ ID NO: 32569 - DNA, 19 bp, Homo sapiens
taggttatccgtgttgcct

SEQ ID NO: 32570 - DNA, 20 bp, Homo sapiens
taggttatccgtgttgcctt

SEQ ID NO: 32571 - DNA, 21 bp, Homo sapiens
taggttatccgtgttgccttc

SEQ ID NO: 32572 - DNA, 23 bp, Homo sapiens
taggttatccgtgttgccttcgc

SEQ ID NO: 32573 - DNA, 24 bp, Homo sapiens
taggttatccgtgttgccttcgct

SEQ ID NO: 32574 - DNA, 16 bp, Homo sapiens
gttatccgtgttgcct

SEQ ID NO: 32575 - DNA, 17 bp, Homo sapiens
gttatccgtgttgcctt

SEQ ID NO: 32576 - DNA, 18 bp, Homo sapiens
gttatccgtgttgccttc

SEQ ID NO: 32577 - DNA, 19 bp, Homo sapiens
gttatccgtgttgccttcg

SEQ ID NO: 32578 - DNA, 20 bp, Homo sapiens
gttatccgtgttgccttcgc

SEQ ID NO: 32579 - DNA, 21 bp, Homo sapiens
gttatccgtgttgccttcgct

SEQ ID NO: 32580 - DNA, 22 bp, Homo sapiens
gttatccgtgttgccttcgctt

SEQ ID NO: 32581 - DNA, 17 bp, Homo sapiens
aatcatacacggttgac

SEQ ID NO: 32582 - DNA, 18 bp, Homo sapiens
aatcatacacggttgacc

SEQ ID NO: 32583 - DNA, 20 bp, Homo sapiens
aatcatacacggttgaccta

SEQ ID NO: 32584 - DNA, 21 bp, Homo sapiens
aatcatacacggttgacctat

SEQ ID NO: 32585 - DNA, 23 bp, Homo sapiens
aatcatacacggttgacctattt

SEQ ID NO: 32586 - DNA, 24 bp, Homo sapiens
aatcatacacggttgacctatttt

SEQ ID NO: 32587 - DNA, 26 bp, Homo sapiens
aatcatacacggttgacctatttttc

SEQ ID NO: 32588 - DNA, 21 bp, Homo sapiens
atcatacacggttgacctatt

SEQ ID NO: 32589 - DNA, 18 bp, Homo sapiens
atacacggttgacctatt

SEQ ID NO: 32590 - DNA, 17 bp, Homo sapiens
tgagtattacatggcca

SEQ ID NO: 32591 - DNA, 20 bp, Homo sapiens
tgagtattacatggccaatc

SEQ ID NO: 32592 - DNA, 21 bp, Homo sapiens
tgagtattacatggccaatct

SEQ ID NO: 32593 - DNA, 23 bp, Homo sapiens
tgagtattacatggccaatctcc

SEQ ID NO: 32594 - DNA, 24 bp, Homo sapiens
tgagtattacatggccaatctcct

SEQ ID NO: 32595 - DNA, 18 bp, Homo sapiens
agtattacatggccaatc

SEQ ID NO: 32596 - DNA, 20 bp, Homo sapiens
agtattacatggccaatctc

SEQ ID NO: 32597 - DNA, 21 bp, Homo sapiens
agtattacatggccaatctcc

SEQ ID NO: 32598 - DNA, 22 bp, Homo sapiens
agtattacatggccaatctcct

SEQ ID NO: 32599 - DNA, 23 bp, Homo sapiens
agtattacatggccaatctcctt

SEQ ID NO: 32600 - DNA, 25 bp, Homo sapiens
agtattacatggccaatctcctttc

SEQ ID NO: 32601 - DNA, 17 bp, Homo sapiens
agaggttgcccttggtg

SEQ ID NO: 32602 - DNA, 18 bp, Homo sapiens
agaggttgcccttggtga

SEQ ID NO: 32603 - DNA, 19 bp, Homo sapiens
agaggttgcccttggtgaa

SEQ ID NO: 32604 - DNA, 20 bp, Homo sapiens
agaggttgcccttggtgaat

SEQ ID NO: 32605 - DNA, 21 bp, Homo sapiens
agaggttgcccttggtgaatt

SEQ ID NO: 32606 - DNA, 23 bp, Homo sapiens
agaggttgcccttggtgaattcg

SEQ ID NO: 32607 - DNA, 25 bp, Homo sapiens
agaggttgcccttggtgaattcgct

SEQ ID NO: 32608 - DNA, 26 bp, Homo sapiens
agaggttgcccttggtgaattcgctt

SEQ ID NO: 32609 - DNA, 22 bp, Homo sapiens
gaggttgcccttggtgaattcg

SEQ ID NO: 32610 - DNA, 19 bp, Homo sapiens
aatcacacaaaggcaactt

SEQ ID NO: 32611 - DNA, 21 bp, Homo sapiens
aatcacacaaaggcaactttt

SEQ ID NO: 32612 - DNA, 22 bp, Homo sapiens
aatcacacaaaggcaacttttg

SEQ ID NO: 32613 - DNA, 23 bp, Homo sapiens
aatcacacaaaggcaacttttgt

SEQ ID NO: 32614 - DNA, 25 bp, Homo sapiens
aatcacacaaaggcaacttttgttt

SEQ ID NO: 32615 - DNA, 16 bp, Homo sapiens
atcacacaaaggcaac

SEQ ID NO: 32616 - DNA, 17 bp, Homo sapiens
atcacacaaaggcaact

SEQ ID NO: 32617 - DNA, 18 bp, Homo sapiens
atcacacaaaggcaactt

SEQ ID NO: 32618 - DNA, 19 bp, Homo sapiens
atcacacaaaggcaacttt

SEQ ID NO: 32619 - DNA, 20 bp, Homo sapiens
atcacacaaaggcaactttt

SEQ ID NO: 32620 - DNA, 21 bp, Homo sapiens
atcacacaaaggcaacttttg

SEQ ID NO: 32621 - DNA, 23 bp, Homo sapiens
atcacacaaaggcaacttttgtt

SEQ ID NO: 32622 - DNA, 24 bp, Homo sapiens
atcacacaaaggcaacttttgttt

SEQ ID NO: 32623 - DNA, 27 bp, Homo sapiens
atcacacaaaggcaacttttgtttgag

SEQ ID NO: 32624 - DNA, 20 bp, Homo sapiens
cacacaaaggcaacttttgt

SEQ ID NO: 32625 - DNA, 17 bp, Homo sapiens
aaaggattctgctgtcg

SEQ ID NO: 32626 - DNA, 18 bp, Homo sapiens
aaaggattctgctgtcgg

SEQ ID NO: 32627 - DNA, 19 bp, Homo sapiens
aaaggattctgctgtcggt

SEQ ID NO: 32628 - DNA, 20 bp, Homo sapiens
aaaggattctgctgtcggtc

SEQ ID NO: 32629 - DNA, 21 bp, Homo sapiens
aaaggattctgctgtcggtcc

SEQ ID NO: 32630 - DNA, 22 bp, Homo sapiens
aaaggattctgctgtcggtccc

SEQ ID NO: 32631 - DNA, 23 bp, Homo sapiens
aaaggattctgctgtcggtccca

SEQ ID NO: 32632 - DNA, 24 bp, Homo sapiens
aaaggattctgctgtcggtcccac

SEQ ID NO: 32633 - DNA, 26 bp, Homo sapiens
aaaggattctgctgtcggtcccactc

SEQ ID NO: 32634 - DNA, 27 bp, Homo sapiens
aaaggattctgctgtcggtcccactcc

SEQ ID NO: 32635 - DNA, 28 bp, Homo sapiens
aaaggattctgctgtcggtcccactcca

SEQ ID NO: 32636 - DNA, 22 bp, Homo sapiens
ggtggtgggcacagaatctgga

SEQ ID NO: 32637 - DNA, 24 bp, Homo sapiens
ggtggtgggcacagaatctggact

SEQ ID NO: 32638 - DNA, 21 bp, Homo sapiens
gtggtgggcacagaatctgga

SEQ ID NO: 32639 - DNA, 20 bp, Homo sapiens
tggtgggcacagaatctgga

SEQ ID NO: 32640 - DNA, 21 bp, Homo sapiens
tggtgggcacagaatctggac

SEQ ID NO: 32641 - DNA, 23 bp, Homo sapiens
tggtgggcacagaatctggactc

SEQ ID NO: 32642 - DNA, 20 bp, Homo sapiens
gtgggcacagaatctggact

SEQ ID NO: 32643 - DNA, 18 bp, Homo sapiens
aggttacccgagcaactt

SEQ ID NO: 32644 - DNA, 19 bp, Homo sapiens
aggttacccgagcaacttt

SEQ ID NO: 32645 - DNA, 20 bp, Homo sapiens
aggttacccgagcaactttg

SEQ ID NO: 32646 - DNA, 21 bp, Homo sapiens
aggttacccgagcaactttgc

SEQ ID NO: 32647 - DNA, 22 bp, Homo sapiens
aggttacccgagcaactttgca

SEQ ID NO: 32648 - DNA, 24 bp, Homo sapiens
aggttacccgagcaactttgcatc

SEQ ID NO: 32649 - DNA, 25 bp, Homo sapiens
aggttacccgagcaactttgcatct

SEQ ID NO: 32650 - DNA, 27 bp, Homo sapiens
aggttacccgagcaactttgcatctgg

SEQ ID NO: 32651 - DNA, 18 bp, Homo sapiens
cgaatgttgctcggtgaa

SEQ ID NO: 32652 - DNA, 20 bp, Homo sapiens
cgaatgttgctcggtgaacc

SEQ ID NO: 32653 - DNA, 22 bp, Homo sapiens
cgaatgttgctcggtgaacccc

SEQ ID NO: 32654 - DNA, 23 bp, Homo sapiens
cgaatgttgctcggtgaacccct

SEQ ID NO: 32655 - DNA, 24 bp, Homo sapiens
cgaatgttgctcggtgaacccctt

SEQ ID NO: 32656 - DNA, 25 bp, Homo sapiens
cgaatgttgctcggtgaaccccttt

SEQ ID NO: 32657 - DNA, 27 bp, Homo sapiens
cgaatgttgctcggtgaaccccttttc

SEQ ID NO: 32658 - DNA, 28 bp, Homo sapiens
cgaatgttgctcggtgaaccccttttcg

SEQ ID NO: 32659 - DNA, 16 bp, Homo sapiens
gaatgttgctcggtga

SEQ ID NO: 32660 - DNA, 17 bp, Homo sapiens
gaatgttgctcggtgaa

SEQ ID NO: 32661 - DNA, 18 bp, Homo sapiens
gaatgttgctcggtgaac

SEQ ID NO: 32662 - DNA, 19 bp, Homo sapiens
gaatgttgctcggtgaacc

SEQ ID NO: 32663 - DNA, 20 bp, Homo sapiens
gaatgttgctcggtgaaccc

SEQ ID NO: 32664 - DNA, 21 bp, Homo sapiens
gaatgttgctcggtgaacccc

SEQ ID NO: 32665 - DNA, 23 bp, Homo sapiens
gaatgttgctcggtgaacccctt

SEQ ID NO: 32666 - DNA, 24 bp, Homo sapiens
gaatgttgctcggtgaaccccttt

SEQ ID NO: 32667 - DNA, 26 bp, Homo sapiens
gaatgttgctcggtgaaccccttttc

SEQ ID NO: 32668 - DNA, 27 bp, Homo sapiens
gaatgttgctcggtgaaccccttttcg

SEQ ID NO: 32669 - DNA, 21 bp, Homo sapiens
aatgttgctcggtgaacccct

SEQ ID NO: 32670 - DNA, 26 bp, Homo sapiens
gatggtcgaccagttggaaagtaatt

SEQ ID NO: 32671 - DNA, 21 bp, Homo sapiens
atggtcgaccagttggaaagt

SEQ ID NO: 32672 - DNA, 24 bp, Homo sapiens
atggtcgaccagttggaaagtaat

SEQ ID NO: 32673 - DNA, 16 bp, Homo sapiens
tggtcgaccagttgga

SEQ ID NO: 32674 - DNA, 19 bp, Homo sapiens
tggtcgaccagttggaaag

SEQ ID NO: 32675 - DNA, 20 bp, Homo sapiens
tggtcgaccagttggaaagt

SEQ ID NO: 32676 - DNA, 21 bp, Homo sapiens
tggtcgaccagttggaaagta

SEQ ID NO: 32677 - DNA, 22 bp, Homo sapiens
tggtcgaccagttggaaagtaa

SEQ ID NO: 32678 - DNA, 24 bp, Homo sapiens
tggtcgaccagttggaaagtaatt

SEQ ID NO: 32679 - DNA, 25 bp, Homo sapiens
tggtcgaccagttggaaagtaattg

SEQ ID NO: 32680 - DNA, 28 bp, Homo sapiens
tggtcgaccagttggaaagtaattgttt

SEQ ID NO: 32681 - DNA, 22 bp, Homo sapiens
ggtcgaccagttggaaagtaat

SEQ ID NO: 32682 - DNA, 17 bp, Homo sapiens
tcgaccagttggaaagt

SEQ ID NO: 32683 - DNA, 23 bp, Homo sapiens
tgtacttcacctggtccactagc

SEQ ID NO: 32684 - DNA, 20 bp, Homo sapiens
gtacttcacctggtccacta

SEQ ID NO: 32685 - DNA, 21 bp, Homo sapiens
gtacttcacctggtccactag

SEQ ID NO: 32686 - DNA, 22 bp, Homo sapiens
gtacttcacctggtccactagc

SEQ ID NO: 32687 - DNA, 23 bp, Homo sapiens
gtacttcacctggtccactagcc

SEQ ID NO: 32688 - DNA, 21 bp, Homo sapiens
tacttcacctggtccactagc

SEQ ID NO: 32689 - DNA, 22 bp, Homo sapiens
tacttcacctggtccactagcc

SEQ ID NO: 32690 - DNA, 21 bp, Homo sapiens
acttcacctggtccactagcc

SEQ ID NO: 32691 - DNA, 20 bp, Homo sapiens
cttcacctggtccactagcc

SEQ ID NO: 32692 - DNA, 21 bp, Homo sapiens
cttcacctggtccactagccg

SEQ ID NO: 32693 - DNA, 22 bp, Homo sapiens
cttcacctggtccactagccgt

SEQ ID NO: 32694 - DNA, 23 bp, Homo sapiens
cttcacctggtccactagccgtc

SEQ ID NO: 32695 - DNA, 17 bp, Homo sapiens
ttcacctggtccactag

SEQ ID NO: 32696 - DNA, 18 bp, Homo sapiens
ttcacctggtccactagc

SEQ ID NO: 32697 - DNA, 20 bp, Homo sapiens
ttcacctggtccactagccg

SEQ ID NO: 32698 - DNA, 21 bp, Homo sapiens
ttcacctggtccactagccgt

SEQ ID NO: 32699 - DNA, 25 bp, Homo sapiens
ttcacctggtccactagccgtccgt

SEQ ID NO: 32700 - DNA, 21 bp, Homo sapiens
acctggtccactagccgtccg

SEQ ID NO: 32701 - DNA, 18 bp, Homo sapiens
agatcgaccgtgttatat

SEQ ID NO: 32702 - DNA, 19 bp, Homo sapiens
agatcgaccgtgttatatt

SEQ ID NO: 32703 - DNA, 20 bp, Homo sapiens
agatcgaccgtgttatattc

SEQ ID NO: 32704 - DNA, 21 bp, Homo sapiens
agatcgaccgtgttatattcg

SEQ ID NO: 32705 - DNA, 23 bp, Homo sapiens
agatcgaccgtgttatattcgct

SEQ ID NO: 32706 - DNA, 25 bp, Homo sapiens
agatcgaccgtgttatattcgcttt

SEQ ID NO: 32707 - DNA, 16 bp, Homo sapiens
gaccgtgttatattcg

SEQ ID NO: 32708 - DNA, 18 bp, Homo sapiens
gaataatacatggttgat

SEQ ID NO: 32709 - DNA, 20 bp, Homo sapiens
gaataatacatggttgatct

SEQ ID NO: 32710 - DNA, 21 bp, Homo sapiens
gaataatacatggttgatctt

SEQ ID NO: 32711 - DNA, 22 bp, Homo sapiens
gaataatacatggttgatcttt

SEQ ID NO: 32712 - DNA, 23 bp, Homo sapiens
gaataatacatggttgatctttt

SEQ ID NO: 32713 - DNA, 18 bp, Homo sapiens
aataatacatggttgatc

SEQ ID NO: 32714 - DNA, 19 bp, Homo sapiens
aataatacatggttgatct

SEQ ID NO: 32715 - DNA, 20 bp, Homo sapiens
aataatacatggttgatctt

SEQ ID NO: 32716 - DNA, 22 bp, Homo sapiens
aataatacatggttgatctttt

SEQ ID NO: 32717 - DNA, 23 bp, Homo sapiens
aataatacatggttgatcttttc

SEQ ID NO: 32718 - DNA, 24 bp, Homo sapiens
aataatacatggttgatcttttct

SEQ ID NO: 32719 - DNA, 25 bp, Homo sapiens
aataatacatggttgatcttttctc

SEQ ID NO: 32720 - DNA, 26 bp, Homo sapiens
aataatacatggttgatcttttctca

SEQ ID NO: 32721 - DNA, 22 bp, Homo sapiens
gaggttgtctgtgatgagttcg

SEQ ID NO: 32722 - DNA, 23 bp, Homo sapiens
gaggttgtctgtgatgagttcgc

SEQ ID NO: 32723 - DNA, 19 bp, Homo sapiens
aggttgtctgtgatgagtt

SEQ ID NO: 32724 - DNA, 22 bp, Homo sapiens
aggttgtctgtgatgagttcgc

SEQ ID NO: 32725 - DNA, 23 bp, Homo sapiens
aggttgtctgtgatgagttcgct

SEQ ID NO: 32726 - DNA, 24 bp, Homo sapiens
aggttgtctgtgatgagttcgctt

SEQ ID NO: 32727 - DNA, 25 bp, Homo sapiens
aggttgtctgtgatgagttcgcttt

SEQ ID NO: 32728 - DNA, 22 bp, Homo sapiens
gtctgtgatgagttcgctttta

SEQ ID NO: 32729 - DNA, 17 bp, Homo sapiens
tgatgagttcgctttta

SEQ ID NO: 32730 - DNA, 18 bp, Homo sapiens
aatataacacagatggcc

SEQ ID NO: 32731 - DNA, 19 bp, Homo sapiens
aatataacacagatggcct

SEQ ID NO: 32732 - DNA, 20 bp, Homo sapiens
aatataacacagatggcctg

SEQ ID NO: 32733 - DNA, 22 bp, Homo sapiens
aatataacacagatggcctgtt

SEQ ID NO: 32734 - DNA, 23 bp, Homo sapiens
aatataacacagatggcctgttt

SEQ ID NO: 32735 - DNA, 24 bp, Homo sapiens
aatataacacagatggcctgtttt

SEQ ID NO: 32736 - DNA, 25 bp, Homo sapiens
aatataacacagatggcctgttttc

SEQ ID NO: 32737 - DNA, 19 bp, Homo sapiens
atataacacagatggcctg

SEQ ID NO: 32738 - DNA, 20 bp, Homo sapiens
atataacacagatggcctgt

SEQ ID NO: 32739 - DNA, 19 bp, Homo sapiens
aggttgcctgtgaggtgtt

SEQ ID NO: 32740 - DNA, 20 bp, Homo sapiens
aggttgcctgtgaggtgttc

SEQ ID NO: 32741 - DNA, 22 bp, Homo sapiens
aggttgcctgtgaggtgttcac

SEQ ID NO: 32742 - DNA, 18 bp, Homo sapiens
aatattatacagtcaacc

SEQ ID NO: 32743 - DNA, 19 bp, Homo sapiens
aatattatacagtcaacct

SEQ ID NO: 32744 - DNA, 20 bp, Homo sapiens
aatattatacagtcaacctc

SEQ ID NO: 32745 - DNA, 22 bp, Homo sapiens
aatattatacagtcaacctctt

SEQ ID NO: 32746 - DNA, 23 bp, Homo sapiens
aatattatacagtcaacctcttt

SEQ ID NO: 32747 - DNA, 24 bp, Homo sapiens
aatattatacagtcaacctctttc

SEQ ID NO: 32748 - DNA, 25 bp, Homo sapiens
aatattatacagtcaacctctttcc

SEQ ID NO: 32749 - DNA, 26 bp, Homo sapiens
aatattatacagtcaacctctttccg

SEQ ID NO: 32750 - DNA, 20 bp, Homo sapiens
atattatacagtcaacctct

SEQ ID NO: 32751 - DNA, 23 bp, Homo sapiens
aacgtcgagactggagcgcccga

SEQ ID NO: 32752 - DNA, 24 bp, Homo sapiens
gaacgtcgagactggagcgcccga

SEQ ID NO: 32753 - DNA, 22 bp, Homo sapiens
aacgtcgagactggagcgcccg

SEQ ID NO: 32754 - DNA, 23 bp, Homo sapiens
cgggaacgtcgagactggagcgc

SEQ ID NO: 32755 - DNA, 22 bp, Homo sapiens
cgggaacgtcgagactggagcg

SEQ ID NO: 32756 - DNA, 20 bp, Homo sapiens
gggaacgtcgagactggagc

SEQ ID NO: 32757 - DNA, 21 bp, Homo sapiens
cgggaacgtcgagactggagc

SEQ ID NO: 32758 - DNA, 22 bp, Homo sapiens
ccgggaacgtcgagactggagc

SEQ ID NO: 32759 - DNA, 25 bp, Homo sapiens
accccgggaacgtcgagactggagc

SEQ ID NO: 32760 - DNA, 20 bp, Homo sapiens
cgggaacgtcgagactggag

SEQ ID NO: 32761 - DNA, 21 bp, Homo sapiens
ccgggaacgtcgagactggag

SEQ ID NO: 32762 - DNA, 19 bp, Homo sapiens
cgggaacgtcgagactgga

SEQ ID NO: 32763 - DNA, 25 bp, Homo sapiens
acccgtcccgttcgtccccggacgt

SEQ ID NO: 32764 - DNA, 24 bp, Homo sapiens
acccgtcccgttcgtccccggacg

SEQ ID NO: 32765 - DNA, 22 bp, Homo sapiens
cccgtcccgttcgtccccggac

SEQ ID NO: 32766 - DNA, 23 bp, Homo sapiens
acccgtcccgttcgtccccggac

SEQ ID NO: 32767 - DNA, 21 bp, Homo sapiens
cccgtcccgttcgtccccgga

SEQ ID NO: 32768 - DNA, 21 bp, Homo sapiens
acccgtcccgttcgtccccgg

SEQ ID NO: 32769 - DNA, 20 bp, Homo sapiens
acccgtcccgttcgtccccg

SEQ ID NO: 32770 - DNA, 19 bp, Homo sapiens
acccgtcccgttcgtcccc

SEQ ID NO: 32771 - DNA, 18 bp, Homo sapiens
acccgtcccgttcgtccc

SEQ ID NO: 32772 - DNA, 16 bp, Homo sapiens
acccgtcccgttcgtc

SEQ ID NO: 32773 - DNA, 19 bp, Homo sapiens
gttctggagtctaggattc

SEQ ID NO: 32774 - DNA, 23 bp, Homo sapiens
aactgttaagaaccactggaccc

SEQ ID NO: 32775 - DNA, 22 bp, Homo sapiens
aactgttaagaaccactggacc

SEQ ID NO: 32776 - DNA, 24 bp, Homo sapiens
tgaactgttaagaaccactggacc

SEQ ID NO: 32777 - DNA, 25 bp, Homo sapiens
ttgaactgttaagaaccactggacc

SEQ ID NO: 32778 - DNA, 21 bp, Homo sapiens
aactgttaagaaccactggac

SEQ ID NO: 32779 - DNA, 23 bp, Homo sapiens
tgaactgttaagaaccactggac

SEQ ID NO: 32780 - DNA, 24 bp, Homo sapiens
ttgaactgttaagaaccactggac

SEQ ID NO: 32781 - DNA, 22 bp, Homo sapiens
tgaactgttaagaaccactgga

SEQ ID NO: 32782 - DNA, 21 bp, Homo sapiens
tgaactgttaagaaccactgg

SEQ ID NO: 32783 - DNA, 22 bp, Homo sapiens
ttgaactgttaagaaccactgg

SEQ ID NO: 32784 - DNA, 21 bp, Homo sapiens
ttgaactgttaagaaccactg

SEQ ID NO: 32785 - DNA, 20 bp, Homo sapiens
ttgaactgttaagaaccact

SEQ ID NO: 32786 - DNA, 19 bp, Homo sapiens
ttgaactgttaagaaccac

SEQ ID NO: 32787 - DNA, 17 bp, Homo sapiens
ttgaactgttaagaacc

SEQ ID NO: 32788 - DNA, 16 bp, Homo sapiens
acatttcacaattgcg

SEQ ID NO: 32789 - DNA, 27 bp, Homo sapiens
tagtggtcctaaacatttcacaattgc

SEQ ID NO: 32790 - DNA, 24 bp, Homo sapiens
agtggtcctaaacatttcacaatt

SEQ ID NO: 32791 - DNA, 23 bp, Homo sapiens
tagtggtcctaaacatttcacaa

SEQ ID NO: 32792 - DNA, 19 bp, Homo sapiens
gtggtcctaaacatttcac

SEQ ID NO: 32793 - DNA, 20 bp, Homo sapiens
gtgaaatgtttaggaccact

SEQ ID NO: 32794 - DNA, 21 bp, Homo sapiens
gtgaaatgtttaggaccacta

SEQ ID NO: 32795 - DNA, 23 bp, Homo sapiens
gtgaaatgtttaggaccactaga

SEQ ID NO: 32796 - DNA, 24 bp, Homo sapiens
gtgaaatgtttaggaccactagac

SEQ ID NO: 32797 - DNA, 25 bp, Homo sapiens
gtgaaatgtttaggaccactagacc

SEQ ID NO: 32798 - DNA, 19 bp, Homo sapiens
tgaaatgtttaggaccact

SEQ ID NO: 32799 - DNA, 20 bp, Homo sapiens
tgaaatgtttaggaccacta

SEQ ID NO: 32800 - DNA, 21 bp, Homo sapiens
tgaaatgtttaggaccactag

SEQ ID NO: 32801 - DNA, 22 bp, Homo sapiens
tgaaatgtttaggaccactaga

SEQ ID NO: 32802 - DNA, 24 bp, Homo sapiens
tgaaatgtttaggaccactagacc

SEQ ID NO: 32803 - DNA, 17 bp, Homo sapiens
tagtggtcctaaacatt

SEQ ID NO: 32804 - DNA, 22 bp, Homo sapiens
gggtgagggcaggtggttcttc

SEQ ID NO: 32805 - DNA, 19 bp, Homo sapiens
ggtgagggcaggtggttct

SEQ ID NO: 32806 - DNA, 20 bp, Homo sapiens
gggtgagggcaggtggttct

SEQ ID NO: 32807 - DNA, 19 bp, Homo sapiens
gggtgagggcaggtggttc

SEQ ID NO: 32808 - DNA, 25 bp, Homo sapiens
cgagtggggtgagggcaggtggttc

SEQ ID NO: 32809 - DNA, 17 bp, Homo sapiens
ggtgagggcaggtggtt

SEQ ID NO: 32810 - DNA, 22 bp, Homo sapiens
agtggggtgagggcaggtggtt

SEQ ID NO: 32811 - DNA, 21 bp, Homo sapiens
agtggggtgagggcaggtggt

SEQ ID NO: 32812 - DNA, 20 bp, Homo sapiens
gagtggggtgagggcaggtg

SEQ ID NO: 32813 - DNA, 16 bp, Homo sapiens
cgagtggggtgagggc

SEQ ID NO: 32814 - DNA, 24 bp, Homo sapiens
tcacctggctggcccgcccaggac

SEQ ID NO: 32815 - DNA, 23 bp, Homo sapiens
tcacctggctggcccgcccagga

SEQ ID NO: 32816 - DNA, 22 bp, Homo sapiens
tcacctggctggcccgcccagg

SEQ ID NO: 32817 - DNA, 22 bp, Homo sapiens
ctcacctggctggcccgcccag

SEQ ID NO: 32818 - DNA, 20 bp, Homo sapiens
tcacctggctggcccgccca

SEQ ID NO: 32819 - DNA, 18 bp, Homo sapiens
tcacctggctggcccgcc

SEQ ID NO: 32820 - DNA, 24 bp, Homo sapiens
tgaggcggggccaggagggtgtgt

SEQ ID NO: 32821 - DNA, 23 bp, Homo sapiens
tgaggcggggccaggagggtgtg

SEQ ID NO: 32822 - DNA, 21 bp, Homo sapiens
gtgaggcggggccaggagggt

SEQ ID NO: 32823 - DNA, 20 bp, Homo sapiens
gtgaggcggggccaggaggg

SEQ ID NO: 32824 - DNA, 19 bp, Homo sapiens
gtgaggcggggccaggagg

SEQ ID NO: 32825 - DNA, 18 bp, Homo sapiens
gtgaggcggggccaggag

SEQ ID NO: 32826 - DNA, 16 bp, Homo sapiens
tgaggcggggccagga

SEQ ID NO: 32827 - DNA, 23 bp, Homo sapiens
ggctgagctgaactgggctgagc

SEQ ID NO: 32828 - DNA, 20 bp, Homo sapiens
ggctgagctgaactgggctg

SEQ ID NO: 32829 - DNA, 19 bp, Homo sapiens
ggctgagctgaactgggct

SEQ ID NO: 32830 - DNA, 17 bp, Homo sapiens
gctgggctgggttgggc

SEQ ID NO: 32831 - DNA, 21 bp, Homo sapiens
ttgggctgggctgggttgggc

SEQ ID NO: 32832 - DNA, 23 bp, Homo sapiens
ctgggttgggctgggctgggttg

SEQ ID NO: 32833 - DNA, 22 bp, Homo sapiens
ctgggttgggctgggctgggtt

SEQ ID NO: 32834 - DNA, 22 bp, Homo sapiens
ccgagctgggttgggctgggct

SEQ ID NO: 32835 - DNA, 16 bp, Homo sapiens
cgagctgggttgggct

SEQ ID NO: 32836 - DNA, 24 bp, Homo sapiens
ttggatgagctgggctgaactggg

SEQ ID NO: 32837 - DNA, 19 bp, Homo sapiens
atgagctgggctgaactgg

SEQ ID NO: 32838 - DNA, 25 bp, Homo sapiens
gagcttggatgagctgggctgaact

SEQ ID NO: 32839 - DNA, 22 bp, Homo sapiens
ctgagcttggatgagctgggct

SEQ ID NO: 32840 - DNA, 17 bp, Homo sapiens
tgagctgagcttggatg

SEQ ID NO: 32841 - DNA, 22 bp, Homo sapiens
gagccgagctgagcttagctgg

SEQ ID NO: 32842 - DNA, 21 bp, Homo sapiens
tgagccgagctgagcttagct

SEQ ID NO: 32843 - DNA, 20 bp, Homo sapiens
tgagccgagctgagcttagc

SEQ ID NO: 32844 - DNA, 19 bp, Homo sapiens
tgagccgagctgagcttag

SEQ ID NO: 32845 - DNA, 18 bp, Homo sapiens
tgagccgagctgagctta

SEQ ID NO: 32846 - DNA, 21 bp, Homo sapiens
gagctgagccgagctgagctt

SEQ ID NO: 32847 - DNA, 22 bp, Homo sapiens
catccagttctctgagggggct

SEQ ID NO: 32848 - DNA, 21 bp, Homo sapiens
catccagttctctgagggggc

SEQ ID NO: 32849 - DNA, 20 bp, Homo sapiens
tgacccatccagttctctga

SEQ ID NO: 32850 - DNA, 21 bp, Homo sapiens
aaggcaactggatgggagacc

SEQ ID NO: 32851 - DNA, 23 bp, Homo sapiens
taacccctaaggcaactggatgg

SEQ ID NO: 32852 - DNA, 21 bp, Homo sapiens
aacccctaaggcaactggatg

SEQ ID NO: 32853 - DNA, 20 bp, Homo sapiens
aacccctaaggcaactggat

SEQ ID NO: 32854 - DNA, 19 bp, Homo sapiens
tgtaaacatccttgactgg

SEQ ID NO: 32855 - DNA, 20 bp, Homo sapiens
tgtaaacatccttgactgga

SEQ ID NO: 32856 - DNA, 21 bp, Homo sapiens
tgtaaacatccttgactggaa

SEQ ID NO: 32857 - DNA, 23 bp, Homo sapiens
tgtaaacatccttgactggaagc

SEQ ID NO: 32858 - DNA, 24 bp, Homo sapiens
tgtaaacatccttgactggaagct

SEQ ID NO: 32859 - DNA, 25 bp, Homo sapiens
tgtaaacatccttgactggaagctg

SEQ ID NO: 32860 - DNA, 23 bp, Homo sapiens
gtaaacatccttgactggaagct

SEQ ID NO: 32861 - DNA, 18 bp, Homo sapiens
ctttcagtcggatgttta

SEQ ID NO: 32862 - DNA, 19 bp, Homo sapiens
ctttcagtcggatgtttac

SEQ ID NO: 32863 - DNA, 20 bp, Homo sapiens
ctttcagtcggatgtttaca

SEQ ID NO: 32864 - DNA, 21 bp, Homo sapiens
ctttcagtcggatgtttacag

SEQ ID NO: 32865 - DNA, 23 bp, Homo sapiens
ctttcagtcggatgtttacagcg

SEQ ID NO: 32866 - DNA, 28 bp, Homo sapiens
gtgtgtgtaaacatcctacactctcagc

SEQ ID NO: 32867 - DNA, 25 bp, Homo sapiens
tgtgtgtaaacatcctacactctca

SEQ ID NO: 32868 - DNA, 27 bp, Homo sapiens
tgtgtgtaaacatcctacactctcagc

SEQ ID NO: 32869 - DNA, 26 bp, Homo sapiens
gtgtgtaaacatcctacactctcagc

SEQ ID NO: 32870 - DNA, 27 bp, Homo sapiens
gtgtgtaaacatcctacactctcagct

SEQ ID NO: 32871 - DNA, 24 bp, Homo sapiens
tgtgtaaacatcctacactctcag

SEQ ID NO: 32872 - DNA, 23 bp, Homo sapiens
gtgtaaacatcctacactctcag

SEQ ID NO: 32873 - DNA, 24 bp, Homo sapiens
gtgtaaacatcctacactctcagc

SEQ ID NO: 32874 - DNA, 25 bp, Homo sapiens
gtgtaaacatcctacactctcagct

SEQ ID NO: 32875 - DNA, 17 bp, Homo sapiens
tgtaaacatcctacact

SEQ ID NO: 32876 - DNA, 18 bp, Homo sapiens
tgtaaacatcctacactc

SEQ ID NO: 32877 - DNA, 21 bp, Homo sapiens
tgtaaacatcctacactctca

SEQ ID NO: 32878 - DNA, 22 bp, Homo sapiens
tgtaaacatcctacactctcag

SEQ ID NO: 32879 - DNA, 24 bp, Homo sapiens
tgtaaacatcctacactctcagct

SEQ ID NO: 32880 - DNA, 28 bp, Homo sapiens
tgtaaacatcctacactctcagctgtga

SEQ ID NO: 32881 - DNA, 23 bp, Homo sapiens
gtaaacatcctacactctcagct

SEQ ID NO: 32882 - DNA, 27 bp, Homo sapiens
gtaaacatcctacactctcagctgtga

SEQ ID NO: 32883 - DNA, 24 bp, Homo sapiens
aacatcctacactctcagctgtga

SEQ ID NO: 32884 - DNA, 21 bp, Homo sapiens
tcctacactctcagctgtgag

SEQ ID NO: 32885 - DNA, 21 bp, Homo sapiens
ctgggagagggttgtttactc

SEQ ID NO: 32886 - DNA, 23 bp, Homo sapiens
ctgggagagggttgtttactcct

SEQ ID NO: 32887 - DNA, 24 bp, Homo sapiens
ctgggagagggttgtttactcctt

SEQ ID NO: 32888 - DNA, 25 bp, Homo sapiens
ctgggagagggttgtttactccttc

SEQ ID NO: 32889 - DNA, 27 bp, Homo sapiens
ctgggagagggttgtttactccttctg

SEQ ID NO: 32890 - DNA, 21 bp, Homo sapiens
tgggagagggttgtttactcc

SEQ ID NO: 32891 - DNA, 24 bp, Homo sapiens
tgggagagggttgtttactccttc

SEQ ID NO: 32892 - DNA, 17 bp, Homo sapiens
ggggatgtagagacaac

SEQ ID NO: 32893 - DNA, 26 bp, Homo sapiens
aggcgatgtggggatgtagagacaac

SEQ ID NO: 32894 - DNA, 24 bp, Homo sapiens
aggcgatgtggggatgtagagaca

SEQ ID NO: 32895 - DNA, 21 bp, Homo sapiens
aggcgatgtggggatgtagag

SEQ ID NO: 32896 - DNA, 22 bp, Homo sapiens
tgaggcgatgtggggatgtaga

SEQ ID NO: 32897 - DNA, 19 bp, Homo sapiens
aggcgatgtggggatgtag

SEQ ID NO: 32898 - DNA, 21 bp, Homo sapiens
tgaggcgatgtggggatgtag

SEQ ID NO: 32899 - DNA, 18 bp, Homo sapiens
aggcgatgtggggatgta

SEQ ID NO: 32900 - DNA, 16 bp, Homo sapiens
tgtttgaggcgatgtg

SEQ ID NO: 32901 - DNA, 20 bp, Homo sapiens
cgccccagccgaggttctcg

SEQ ID NO: 32902 - DNA, 23 bp, Homo sapiens
agcccgccccagccgaggttctc

SEQ ID NO: 32903 - DNA, 24 bp, Homo sapiens
cagcccgccccagccgaggttctc

SEQ ID NO: 32904 - DNA, 21 bp, Homo sapiens
agcccgccccagccgaggttc

SEQ ID NO: 32905 - DNA, 20 bp, Homo sapiens
agcccgccccagccgaggtt

SEQ ID NO: 32906 - DNA, 19 bp, Homo sapiens
agcccgccccagccgaggt

SEQ ID NO: 32907 - DNA, 18 bp, Homo sapiens
agcccgccccagccgagg

SEQ ID NO: 32908 - DNA, 16 bp, Homo sapiens
cgggttctggggtgta

SEQ ID NO: 32909 - DNA, 22 bp, Homo sapiens
cgcgggcgggttctggggtgta

SEQ ID NO: 32910 - DNA, 25 bp, Homo sapiens
gccccggcgcgggcgggttctgggg

SEQ ID NO: 32911 - DNA, 21 bp, Homo sapiens
ccggcgcgggcgggttctggg

SEQ ID NO: 32912 - DNA, 24 bp, Homo sapiens
gccccggcgcgggcgggttctggg

SEQ ID NO: 32913 - DNA, 22 bp, Homo sapiens
gccccggcgcgggcgggttctg

SEQ ID NO: 32914 - DNA, 21 bp, Homo sapiens
gccccggcgcgggcgggttct

SEQ ID NO: 32915 - DNA, 18 bp, Homo sapiens
tccggagccccggcgcgg

SEQ ID NO: 32916 - DNA, 17 bp, Homo sapiens
tccggagccccggcgcg

SEQ ID NO: 32917 - DNA, 24 bp, Homo sapiens
ataagacgagcaaaaagcttgttg

SEQ ID NO: 32918 - DNA, 20 bp, Homo sapiens
taagacgagcaaaaagcttg

SEQ ID NO: 32919 - DNA, 18 bp, Homo sapiens
ataagacgagcaaaaagc

SEQ ID NO: 32920 - DNA, 22 bp, Homo sapiens
acgtataagacgagcaaaaagc

SEQ ID NO: 32921 - DNA, 17 bp, Homo sapiens
ataagacgagcaaaaag

SEQ ID NO: 32922 - DNA, 23 bp, Homo sapiens
gagcttttggcccgggttatacc

SEQ ID NO: 32923 - DNA, 21 bp, Homo sapiens
gagcttttggcccgggttata

SEQ ID NO: 32924 - DNA, 20 bp, Homo sapiens
gagcttttggcccgggttat

SEQ ID NO: 32925 - DNA, 16 bp, Homo sapiens
gagcttttggcccggg

SEQ ID NO: 32926 - DNA, 23 bp, Homo sapiens
ataagacgaacaaaaggtttgtc

SEQ ID NO: 32927 - DNA, 21 bp, Homo sapiens
ataagacgaacaaaaggtttg

SEQ ID NO: 32928 - DNA, 22 bp, Homo sapiens
tataagacgaacaaaaggtttg

SEQ ID NO: 32929 - DNA, 20 bp, Homo sapiens
ataagacgaacaaaaggttt

SEQ ID NO: 32930 - DNA, 18 bp, Homo sapiens
ataagacgaacaaaaggt

SEQ ID NO: 32931 - DNA, 19 bp, Homo sapiens
tataagacgaacaaaaggt

SEQ ID NO: 32932 - DNA, 17 bp, Homo sapiens
ataagacgaacaaaagg

SEQ ID NO: 32933 - DNA, 25 bp, Homo sapiens
tgcactctggccttctcccaggctg

SEQ ID NO: 32934 - DNA, 23 bp, Homo sapiens
gcactctggccttctcccaggct

SEQ ID NO: 32935 - DNA, 23 bp, Homo sapiens
tgcactctggccttctcccaggc

SEQ ID NO: 32936 - DNA, 24 bp, Homo sapiens
ttgcactctggccttctcccaggc

SEQ ID NO: 32937 - DNA, 22 bp, Homo sapiens
tgcactctggccttctcccagg

SEQ ID NO: 32938 - DNA, 22 bp, Homo sapiens
ttgcactctggccttctcccag

SEQ ID NO: 32939 - DNA, 23 bp, Homo sapiens
cttgcactctggccttctcccag

SEQ ID NO: 32940 - DNA, 24 bp, Homo sapiens
gatgtatggaatctgtatatatct

SEQ ID NO: 32941 - DNA, 20 bp, Homo sapiens
gtatggaatctgtatatatc

SEQ ID NO: 32942 - DNA, 22 bp, Homo sapiens
atgtatggaatctgtatatatc

SEQ ID NO: 32943 - DNA, 19 bp, Homo sapiens
gtatggaatctgtatatat

SEQ ID NO: 32944 - DNA, 22 bp, Homo sapiens
gatgtatggaatctgtatatat

SEQ ID NO: 32945 - DNA, 22 bp, Homo sapiens
agatgtatggaatctgtatata

SEQ ID NO: 32946 - DNA, 21 bp, Homo sapiens
agatgtatggaatctgtatat

SEQ ID NO: 32947 - DNA, 19 bp, Homo sapiens
gatgtatggaatctgtata

SEQ ID NO: 32948 - DNA, 25 bp, Homo sapiens
cacaaggtattggtattaccttgag

SEQ ID NO: 32949 - DNA, 22 bp, Homo sapiens
acaaggtattggtattaccttg

SEQ ID NO: 32950 - DNA, 23 bp, Homo sapiens
cacaaggtattggtattaccttg

SEQ ID NO: 32951 - DNA, 23 bp, Homo sapiens
aacacaaggtattggtattacct

SEQ ID NO: 32952 - DNA, 22 bp, Homo sapiens
aacacaaggtattggtattacc

SEQ ID NO: 32953 - DNA, 23 bp, Homo sapiens
aaacacaaggtattggtattacc

SEQ ID NO: 32954 - DNA, 19 bp, Homo sapiens
cacaaggtattggtattac

SEQ ID NO: 32955 - DNA, 21 bp, Homo sapiens
aacacaaggtattggtattac

SEQ ID NO: 32956 - DNA, 22 bp, Homo sapiens
aaacacaaggtattggtattac

SEQ ID NO: 32957 - DNA, 20 bp, Homo sapiens
aacacaaggtattggtatta

SEQ ID NO: 32958 - DNA, 21 bp, Homo sapiens
aaacacaaggtattggtatta

SEQ ID NO: 32959 - DNA, 17 bp, Homo sapiens
cacaaggtattggtatt

SEQ ID NO: 32960 - DNA, 19 bp, Homo sapiens
aacacaaggtattggtatt

SEQ ID NO: 32961 - DNA, 20 bp, Homo sapiens
aaacacaaggtattggtatt

SEQ ID NO: 32962 - DNA, 18 bp, Homo sapiens
aacacaaggtattggtat

SEQ ID NO: 32963 - DNA, 19 bp, Homo sapiens
aaacacaaggtattggtat

SEQ ID NO: 32964 - DNA, 25 bp, Homo sapiens
taccagtaccttgtgttcagtggaa

SEQ ID NO: 32965 - DNA, 21 bp, Homo sapiens
taccagtaccttgtgttcagt

SEQ ID NO: 32966 - DNA, 23 bp, Homo sapiens
agtaccagtaccttgtgttcagt

SEQ ID NO: 32967 - DNA, 23 bp, Homo sapiens
tagtaccagtaccttgtgttcag

SEQ ID NO: 32968 - DNA, 19 bp, Homo sapiens
taccagtaccttgtgttca

SEQ ID NO: 32969 - DNA, 18 bp, Homo sapiens
taccagtaccttgtgttc

SEQ ID NO: 32970 - DNA, 21 bp, Homo sapiens
tagtaccagtaccttgtgttc

SEQ ID NO: 32971 - DNA, 22 bp, Homo sapiens
gtagtaccagtaccttgtgttc

SEQ ID NO: 32972 - DNA, 19 bp, Homo sapiens
agtaccagtaccttgtgtt

SEQ ID NO: 32973 - DNA, 20 bp, Homo sapiens
tagtaccagtaccttgtgtt

SEQ ID NO: 32974 - DNA, 21 bp, Homo sapiens
gtagtaccagtaccttgtgtt

SEQ ID NO: 32975 - DNA, 20 bp, Homo sapiens
gtagtaccagtaccttgtgt

SEQ ID NO: 32976 - DNA, 18 bp, Homo sapiens
tagtaccagtaccttgtg

SEQ ID NO: 32977 - DNA, 24 bp, Homo sapiens
tcagtgtctggatttcctagaatg

SEQ ID NO: 32978 - DNA, 22 bp, Homo sapiens
tcagtgtctggatttcctagaa

SEQ ID NO: 32979 - DNA, 23 bp, Homo sapiens
ctcagtgtctggatttcctagaa

SEQ ID NO: 32980 - DNA, 21 bp, Homo sapiens
tcagtgtctggatttcctaga

SEQ ID NO: 32981 - DNA, 22 bp, Homo sapiens
ctcagtgtctggatttcctaga

SEQ ID NO: 32982 - DNA, 21 bp, Homo sapiens
ctcagtgtctggatttcctag

SEQ ID NO: 32983 - DNA, 19 bp, Homo sapiens
ctcagtgtctggatttcct

SEQ ID NO: 32984 - DNA, 23 bp, Homo sapiens
aagacaaactcagagttcccttc

SEQ ID NO: 32985 - DNA, 26 bp, Homo sapiens
tgggaaagacaaactcagagttccct

SEQ ID NO: 32986 - DNA, 27 bp, Homo sapiens
ttgggaaagacaaactcagagttccct

SEQ ID NO: 32987 - DNA, 23 bp, Homo sapiens
tgggaaagacaaactcagagttc

SEQ ID NO: 32988 - DNA, 24 bp, Homo sapiens
ttgggaaagacaaactcagagttc

SEQ ID NO: 32989 - DNA, 23 bp, Homo sapiens
ttgggaaagacaaactcagagtt

SEQ ID NO: 32990 - DNA, 21 bp, Homo sapiens
tgggaaagacaaactcagagt

SEQ ID NO: 32991 - DNA, 22 bp, Homo sapiens
ttgggaaagacaaactcagagt

SEQ ID NO: 32992 - DNA, 23 bp, Homo sapiens
cttgggaaagacaaactcagagt

SEQ ID NO: 32993 - DNA, 21 bp, Homo sapiens
ttgggaaagacaaactcagag

SEQ ID NO: 32994 - DNA, 20 bp, Homo sapiens
ttgggaaagacaaactcaga

SEQ ID NO: 32995 - DNA, 19 bp, Homo sapiens
ttgggaaagacaaactcag

SEQ ID NO: 32996 - DNA, 18 bp, Homo sapiens
ttgggaaagacaaactca

SEQ ID NO: 32997 - DNA, 23 bp, Homo sapiens
tttaagcaggaaatagaatttac

SEQ ID NO: 32998 - DNA, 21 bp, Homo sapiens
tttaagcaggaaatagaattt

SEQ ID NO: 32999 - DNA, 20 bp, Homo sapiens
tttaagcaggaaatagaatt

SEQ ID NO: 33000 - DNA, 19 bp, Homo sapiens
tttaagcaggaaatagaat

SEQ ID NO: 33001 - DNA, 24 bp, Homo sapiens
tccctcactcttctctcaggtgat

SEQ ID NO: 33002 - DNA, 22 bp, Homo sapiens
tccctcactcttctctcaggtg

SEQ ID NO: 33003 - DNA, 23 bp, Homo sapiens
ttccctcactcttctctcaggtg

SEQ ID NO: 33004 - DNA, 26 bp, Homo sapiens
cccttccctcactcttctctcaggtg

SEQ ID NO: 33005 - DNA, 21 bp, Homo sapiens
tccctcactcttctctcaggt

SEQ ID NO: 33006 - DNA, 22 bp, Homo sapiens
ttccctcactcttctctcaggt

SEQ ID NO: 33007 - DNA, 25 bp, Homo sapiens
cccttccctcactcttctctcaggt

SEQ ID NO: 33008 - DNA, 20 bp, Homo sapiens
tccctcactcttctctcagg

SEQ ID NO: 33009 - DNA, 22 bp, Homo sapiens
cttccctcactcttctctcagg

SEQ ID NO: 33010 - DNA, 23 bp, Homo sapiens
ccttccctcactcttctctcagg

SEQ ID NO: 33011 - DNA, 24 bp, Homo sapiens
cccttccctcactcttctctcagg

SEQ ID NO: 33012 - DNA, 19 bp, Homo sapiens
tccctcactcttctctcag

SEQ ID NO: 33013 - DNA, 22 bp, Homo sapiens
cccttccctcactcttctctca

SEQ ID NO: 33014 - DNA, 20 bp, Homo sapiens
cccttccctcactcttctct

SEQ ID NO: 33015 - DNA, 27 bp, Homo sapiens
tgaggggagaatgaggtggagaagccc

SEQ ID NO: 33016 - DNA, 25 bp, Homo sapiens
tgaggggagaatgaggtggagaagc

SEQ ID NO: 33017 - DNA, 26 bp, Homo sapiens
ttgaggggagaatgaggtggagaagc

SEQ ID NO: 33018 - DNA, 27 bp, Homo sapiens
cttgaggggagaatgaggtggagaagc

SEQ ID NO: 33019 - DNA, 24 bp, Homo sapiens
tgaggggagaatgaggtggagaag

SEQ ID NO: 33020 - DNA, 25 bp, Homo sapiens
ttgaggggagaatgaggtggagaag

SEQ ID NO: 33021 - DNA, 23 bp, Homo sapiens
tgaggggagaatgaggtggagaa

SEQ ID NO: 33022 - DNA, 25 bp, Homo sapiens
cttgaggggagaatgaggtggagaa

SEQ ID NO: 33023 - DNA, 22 bp, Homo sapiens
tgaggggagaatgaggtggaga

SEQ ID NO: 33024 - DNA, 24 bp, Homo sapiens
cttgaggggagaatgaggtggaga

SEQ ID NO: 33025 - DNA, 25 bp, Homo sapiens
acttgaggggagaatgaggtggaga

SEQ ID NO: 33026 - DNA, 22 bp, Homo sapiens
ttgaggggagaatgaggtggag

SEQ ID NO: 33027 - DNA, 24 bp, Homo sapiens
acttgaggggagaatgaggtggag

SEQ ID NO: 33028 - DNA, 21 bp, Homo sapiens
ttgaggggagaatgaggtgga

SEQ ID NO: 33029 - DNA, 22 bp, Homo sapiens
cttgaggggagaatgaggtgga

SEQ ID NO: 33030 - DNA, 23 bp, Homo sapiens
acttgaggggagaatgaggtgga

SEQ ID NO: 33031 - DNA, 22 bp, Homo sapiens
acttgaggggagaatgaggtgg

SEQ ID NO: 33032 - DNA, 19 bp, Homo sapiens
ttgaggggagaatgaggtg

SEQ ID NO: 33033 - DNA, 23 bp, Homo sapiens
gagaacttgaggggagaatgagg

SEQ ID NO: 33034 - DNA, 25 bp, Homo sapiens
gccagggcagagggcacaggaatct

SEQ ID NO: 33035 - DNA, 27 bp, Homo sapiens
gccagggcagagggcacaggaatctga

SEQ ID NO: 33036 - DNA, 21 bp, Homo sapiens
ccagggcagagggcacaggaa

SEQ ID NO: 33037 - DNA, 22 bp, Homo sapiens
ccagggcagagggcacaggaat

SEQ ID NO: 33038 - DNA, 23 bp, Homo sapiens
ccagggcagagggcacaggaatc

SEQ ID NO: 33039 - DNA, 24 bp, Homo sapiens
ccagggcagagggcacaggaatct

SEQ ID NO: 33040 - DNA, 26 bp, Homo sapiens
ccagggcagagggcacaggaatctga

SEQ ID NO: 33041 - DNA, 28 bp, Homo sapiens
ccagggcagagggcacaggaatctgagg

SEQ ID NO: 33042 - DNA, 20 bp, Homo sapiens
cagggcagagggcacaggaa

SEQ ID NO: 33043 - DNA, 21 bp, Homo sapiens
cagggcagagggcacaggaat

SEQ ID NO: 33044 - DNA, 22 bp, Homo sapiens
cagggcagagggcacaggaatc

SEQ ID NO: 33045 - DNA, 23 bp, Homo sapiens
cagggcagagggcacaggaatct

SEQ ID NO: 33046 - DNA, 24 bp, Homo sapiens
cagggcagagggcacaggaatctg

SEQ ID NO: 33047 - DNA, 26 bp, Homo sapiens
cagggcagagggcacaggaatctgag

SEQ ID NO: 33048 - DNA, 24 bp, Homo sapiens
agggcagagggcacaggaatctga

SEQ ID NO: 33049 - DNA, 21 bp, Homo sapiens
gcagagggcacaggaatctga

SEQ ID NO: 33050 - DNA, 26 bp, Homo sapiens
ctcaggcctgtggctcctccctcagg

SEQ ID NO: 33051 - DNA, 20 bp, Homo sapiens
caggcctgtggctcctccct

SEQ ID NO: 33052 - DNA, 22 bp, Homo sapiens
caggcctgtggctcctccctca

SEQ ID NO: 33053 - DNA, 23 bp, Homo sapiens
caggcctgtggctcctccctcag

SEQ ID NO: 33054 - DNA, 20 bp, Homo sapiens
aggcctgtggctcctccctc

SEQ ID NO: 33055 - DNA, 21 bp, Homo sapiens
aggcctgtggctcctccctca

SEQ ID NO: 33056 - DNA, 23 bp, Homo sapiens
aggcctgtggctcctccctcagg

SEQ ID NO: 33057 - DNA, 24 bp, Homo sapiens
aggcctgtggctcctccctcagga

SEQ ID NO: 33058 - DNA, 25 bp, Homo sapiens
aggcctgtggctcctccctcaggac

SEQ ID NO: 33059 - DNA, 21 bp, Homo sapiens
acttttttggaagcttggacc

SEQ ID NO: 33060 - DNA, 22 bp, Homo sapiens
acttttttggaagcttggacca

SEQ ID NO: 33061 - DNA, 17 bp, Homo sapiens
tttttggaagcttggac

SEQ ID NO: 33062 - DNA, 22 bp, Homo sapiens
tttttggaagcttggaccaact

SEQ ID NO: 33063 - DNA, 17 bp, Homo sapiens
ttggaccaactagctgg

SEQ ID NO: 33064 - DNA, 18 bp, Homo sapiens
aacagggaaatgggaaga

SEQ ID NO: 33065 - DNA, 25 bp, Homo sapiens
acagggaaatgggaagaactagatt

SEQ ID NO: 33066 - DNA, 20 bp, Homo sapiens
cagggaaatgggaagaacta

SEQ ID NO: 33067 - DNA, 21 bp, Homo sapiens
cagggaaatgggaagaactag

SEQ ID NO: 33068 - DNA, 23 bp, Homo sapiens
cagggaaatgggaagaactagat

SEQ ID NO: 33069 - DNA, 24 bp, Homo sapiens
cagggaaatgggaagaactagatt

SEQ ID NO: 33070 - DNA, 21 bp, Homo sapiens
tagttcttccctttgcccaat

SEQ ID NO: 33071 - DNA, 23 bp, Homo sapiens
tagttcttccctttgcccaatta

SEQ ID NO: 33072 - DNA, 17 bp, Homo sapiens
aggagaggtggaggtag

SEQ ID NO: 33073 - DNA, 19 bp, Homo sapiens
agagatgaacatggaggat

SEQ ID NO: 33074 - DNA, 23 bp, Homo sapiens
gtgacaatagagatgaacatgga

SEQ ID NO: 33075 - DNA, 24 bp, Homo sapiens
tgtgacaatagagatgaacatgga

SEQ ID NO: 33076 - DNA, 22 bp, Homo sapiens
gtgacaatagagatgaacatgg

SEQ ID NO: 33077 - DNA, 23 bp, Homo sapiens
tgtgacaatagagatgaacatgg

SEQ ID NO: 33078 - DNA, 21 bp, Homo sapiens
gtgacaatagagatgaacatg

SEQ ID NO: 33079 - DNA, 24 bp, Homo sapiens
tttgtgacaatagagatgaacatg

SEQ ID NO: 33080 - DNA, 21 bp, Homo sapiens
tgtgacaatagagatgaacat

SEQ ID NO: 33081 - DNA, 20 bp, Homo sapiens
tgtgacaatagagatgaaca

SEQ ID NO: 33082 - DNA, 19 bp, Homo sapiens
accatttgtgacaatagag

SEQ ID NO: 33083 - DNA, 21 bp, Homo sapiens
tatgaagtgagccagcacaga

SEQ ID NO: 33084 - DNA, 23 bp, Homo sapiens
catatgaagtgagccagcacaga

SEQ ID NO: 33085 - DNA, 23 bp, Homo sapiens
acatatgaagtgagccagcacag

SEQ ID NO: 33086 - DNA, 24 bp, Homo sapiens
cacatatgaagtgagccagcacag

SEQ ID NO: 33087 - DNA, 23 bp, Homo sapiens
cacatatgaagtgagccagcaca

SEQ ID NO: 33088 - DNA, 21 bp, Homo sapiens
acatatgaagtgagccagcac

SEQ ID NO: 33089 - DNA, 21 bp, Homo sapiens
cacatatgaagtgagccagca

SEQ ID NO: 33090 - DNA, 22 bp, Homo sapiens
ctggctcatttcatatgtgtgc

SEQ ID NO: 33091 - DNA, 23 bp, Homo sapiens
gctggctcatttcatatgtgtgc

SEQ ID NO: 33092 - DNA, 21 bp, Homo sapiens
ctggctcatttcatatgtgtg

SEQ ID NO: 33093 - DNA, 22 bp, Homo sapiens
gctggctcatttcatatgtgtg

SEQ ID NO: 33094 - DNA, 23 bp, Homo sapiens
tgctggctcatttcatatgtgtg

SEQ ID NO: 33095 - DNA, 21 bp, Homo sapiens
gctggctcatttcatatgtgt

SEQ ID NO: 33096 - DNA, 21 bp, Homo sapiens
tgctggctcatttcatatgtg

SEQ ID NO: 33097 - DNA, 23 bp, Homo sapiens
ggtctgtgctggctcatttcata

SEQ ID NO: 33098 - DNA, 20 bp, Homo sapiens
ggtctgtgctggctcatttc

SEQ ID NO: 33099 - DNA, 24 bp, Homo sapiens
tccctggagtttcttcttaccttt

SEQ ID NO: 33100 - DNA, 22 bp, Homo sapiens
tccctggagtttcttcttacct

SEQ ID NO: 33101 - DNA, 20 bp, Homo sapiens
tccctggagtttcttcttac

SEQ ID NO: 33102 - DNA, 19 bp, Homo sapiens
tccctggagtttcttctta

SEQ ID NO: 33103 - DNA, 24 bp, Homo sapiens
cagagtgacaagctggttaaagaa

SEQ ID NO: 33104 - DNA, 22 bp, Homo sapiens
agagtgacaagctggttaaaga

SEQ ID NO: 33105 - DNA, 23 bp, Homo sapiens
cagagtgacaagctggttaaaga

SEQ ID NO: 33106 - DNA, 21 bp, Homo sapiens
agagtgacaagctggttaaag

SEQ ID NO: 33107 - DNA, 21 bp, Homo sapiens
cagagtgacaagctggttaaa

SEQ ID NO: 33108 - DNA, 22 bp, Homo sapiens
acagagtgacaagctggttaaa

SEQ ID NO: 33109 - DNA, 20 bp, Homo sapiens
cagagtgacaagctggttaa

SEQ ID NO: 33110 - DNA, 21 bp, Homo sapiens
acagagtgacaagctggttaa

SEQ ID NO: 33111 - DNA, 19 bp, Homo sapiens
cagagtgacaagctggtta

SEQ ID NO: 33112 - DNA, 20 bp, Homo sapiens
acagagtgacaagctggtta

SEQ ID NO: 33113 - DNA, 18 bp, Homo sapiens
cagagtgacaagctggtt

SEQ ID NO: 33114 - DNA, 19 bp, Homo sapiens
acagagtgacaagctggtt

SEQ ID NO: 33115 - DNA, 24 bp, Homo sapiens
tatccagcttgttactatatgctt

SEQ ID NO: 33116 - DNA, 23 bp, Homo sapiens
tatccagcttgttactatatgct

SEQ ID NO: 33117 - DNA, 23 bp, Homo sapiens
ttatccagcttgttactatatgc

SEQ ID NO: 33118 - DNA, 21 bp, Homo sapiens
tatccagcttgttactatatg

SEQ ID NO: 33119 - DNA, 22 bp, Homo sapiens
ttatccagcttgttactatatg

SEQ ID NO: 33120 - DNA, 20 bp, Homo sapiens
tatccagcttgttactatat

SEQ ID NO: 33121 - DNA, 21 bp, Homo sapiens
ttatccagcttgttactatat

SEQ ID NO: 33122 - DNA, 24 bp, Homo sapiens
ttggtgaggaccccaagctcggca

SEQ ID NO: 33123 - DNA, 23 bp, Homo sapiens
ttggtgaggaccccaagctcggc

SEQ ID NO: 33124 - DNA, 19 bp, Homo sapiens
gtgaggaccccaagctcgg

SEQ ID NO: 33125 - DNA, 21 bp, Homo sapiens
tggtgaggaccccaagctcgg

SEQ ID NO: 33126 - DNA, 20 bp, Homo sapiens
tggtgaggaccccaagctcg

SEQ ID NO: 33127 - DNA, 21 bp, Homo sapiens
ttggtgaggaccccaagctcg

SEQ ID NO: 33128 - DNA, 20 bp, Homo sapiens
ttggtgaggaccccaagctc

SEQ ID NO: 33129 - DNA, 21 bp, Homo sapiens
ccaagcttggtgaggacccca

SEQ ID NO: 33130 - DNA, 19 bp, Homo sapiens
agcggggaggaagtgggcg

SEQ ID NO: 33131 - DNA, 21 bp, Homo sapiens
agcggggaggaagtgggcgct

SEQ ID NO: 33132 - DNA, 22 bp, Homo sapiens
agcggggaggaagtgggcgctg

SEQ ID NO: 33133 - DNA, 23 bp, Homo sapiens
agcggggaggaagtgggcgctgc

SEQ ID NO: 33134 - DNA, 24 bp, Homo sapiens
agcggggaggaagtgggcgctgct

SEQ ID NO: 33135 - DNA, 27 bp, Homo sapiens
agcggggaggaagtgggcgctgcttct

SEQ ID NO: 33136 - DNA, 23 bp, Homo sapiens
agcaaggcggcatctctctgata

SEQ ID NO: 33137 - DNA, 23 bp, Homo sapiens
gagcaaggcggcatctctctgat

SEQ ID NO: 33138 - DNA, 21 bp, Homo sapiens
agcaaggcggcatctctctga

SEQ ID NO: 33139 - DNA, 22 bp, Homo sapiens
gagcaaggcggcatctctctga

SEQ ID NO: 33140 - DNA, 21 bp, Homo sapiens
gagcaaggcggcatctctctg

SEQ ID NO: 33141 - DNA, 20 bp, Homo sapiens
aggaggagcaaggcggcatc

SEQ ID NO: 33142 - DNA, 23 bp, Homo sapiens
atgccgccttgctccttgaacag

SEQ ID NO: 33143 - DNA, 19 bp, Homo sapiens
gccgccttgctccttgaac

SEQ ID NO: 33144 - DNA, 20 bp, Homo sapiens
atgccgccttgctccttgaa

SEQ ID NO: 33145 - DNA, 22 bp, Homo sapiens
agagatgccgccttgctccttg

SEQ ID NO: 33146 - DNA, 24 bp, Homo sapiens
agagagatgccgccttgctccttg

SEQ ID NO: 33147 - DNA, 23 bp, Homo sapiens
agagagatgccgccttgctcctt

SEQ ID NO: 33148 - DNA, 21 bp, Homo sapiens
ggagagagatgccgccttgct

SEQ ID NO: 33149 - DNA, 16 bp, Homo sapiens
taggagagagatgccg

SEQ ID NO: 33150 - DNA, 22 bp, Homo sapiens
agggggaaagttctatagtcct

SEQ ID NO: 33151 - DNA, 23 bp, Homo sapiens
agggggaaagttctatagtcctg

SEQ ID NO: 33152 - DNA, 24 bp, Homo sapiens
agggggaaagttctatagtcctgt

SEQ ID NO: 33153 - DNA, 25 bp, Homo sapiens
agggggaaagttctatagtcctgta

SEQ ID NO: 33154 - DNA, 26 bp, Homo sapiens
agggggaaagttctatagtcctgtaa

SEQ ID NO: 33155 - DNA, 27 bp, Homo sapiens
agggggaaagttctatagtcctgtaat

SEQ ID NO: 33156 - DNA, 23 bp, Homo sapiens
gggggaaagttctatagtcctgt

SEQ ID NO: 33157 - DNA, 24 bp, Homo sapiens
gggggaaagttctatagtcctgta

SEQ ID NO: 33158 - DNA, 22 bp, Homo sapiens
ggggaaagttctatagtcctgt

SEQ ID NO: 33159 - DNA, 22 bp, Homo sapiens
gaaagttctatagtcctgtaat

SEQ ID NO: 33160 - DNA, 22 bp, Homo sapiens
tcaggactatagaactttcccc

SEQ ID NO: 33161 - DNA, 22 bp, Homo sapiens
ggactatagaactttccccctc

SEQ ID NO: 33162 - DNA, 20 bp, Homo sapiens
gactatagaactttccccct

SEQ ID NO: 33163 - DNA, 21 bp, Homo sapiens
gactatagaactttccccctc

SEQ ID NO: 33164 - DNA, 23 bp, Homo sapiens
gactatagaactttccccctcat

SEQ ID NO: 33165 - DNA, 24 bp, Homo sapiens
gactatagaactttccccctcatc

SEQ ID NO: 33166 - DNA, 18 bp, Homo sapiens
actatagaactttccccc

SEQ ID NO: 33167 - DNA, 21 bp, Homo sapiens
actatagaactttccccctca

SEQ ID NO: 33168 - DNA, 24 bp, Homo sapiens
tgcagatcatgggactgtctcagc

SEQ ID NO: 33169 - DNA, 23 bp, Homo sapiens
tgcagatcatgggactgtctcag

SEQ ID NO: 33170 - DNA, 21 bp, Homo sapiens
gcagatcatgggactgtctca

SEQ ID NO: 33171 - DNA, 22 bp, Homo sapiens
tgcagatcatgggactgtctca

SEQ ID NO: 33172 - DNA, 23 bp, Homo sapiens
ctgcagatcatgggactgtctca

SEQ ID NO: 33173 - DNA, 21 bp, Homo sapiens
tgcagatcatgggactgtctc

SEQ ID NO: 33174 - DNA, 23 bp, Homo sapiens
actgcagatcatgggactgtctc

SEQ ID NO: 33175 - DNA, 22 bp, Homo sapiens
actgcagatcatgggactgtct

SEQ ID NO: 33176 - DNA, 20 bp, Homo sapiens
actgcagatcatgggactgt

SEQ ID NO: 33177 - DNA, 23 bp, Homo sapiens
tgagggcagagccagcttcctga

SEQ ID NO: 33178 - DNA, 21 bp, Homo sapiens
gagggcagagccagcttcctg

SEQ ID NO: 33179 - DNA, 23 bp, Homo sapiens
gagggcagagccagcttcctgat

SEQ ID NO: 33180 - DNA, 24 bp, Homo sapiens
gagggcagagccagcttcctgatc

SEQ ID NO: 33181 - DNA, 21 bp, Homo sapiens
atgaagccttctctgccttac

SEQ ID NO: 33182 - DNA, 23 bp, Homo sapiens
atgaagccttctctgccttacgc

SEQ ID NO: 33183 - DNA, 22 bp, Homo sapiens
tgaagccttctctgccttacgc

SEQ ID NO: 33184 - DNA, 17 bp, Homo sapiens
cgctggaggctgggctg

SEQ ID NO: 33185 - DNA, 19 bp, Homo sapiens
cgctggaggctgggctggg

SEQ ID NO: 33186 - DNA, 20 bp, Homo sapiens
cgctggaggctgggctggga

SEQ ID NO: 33187 - DNA, 22 bp, Homo sapiens
cgctggaggctgggctgggacg

SEQ ID NO: 33188 - DNA, 24 bp, Homo sapiens
cgctggaggctgggctgggacgga

SEQ ID NO: 33189 - DNA, 20 bp, Homo sapiens
aggctgggctgggacggaca

SEQ ID NO: 33190 - DNA, 21 bp, Homo sapiens
aggctgggctgggacggacac

SEQ ID NO: 33191 - DNA, 22 bp, Homo sapiens
aggctgggctgggacggacacc

SEQ ID NO: 33192 - DNA, 20 bp, Homo sapiens
gctgggctgggacggacacc

SEQ ID NO: 33193 - DNA, 18 bp, Homo sapiens
ctgggctgggacggacac

SEQ ID NO: 33194 - DNA, 19 bp, Homo sapiens
ctgggctgggacggacacc

SEQ ID NO: 33195 - DNA, 21 bp, Homo sapiens
ctgggctgggacggacacccg

SEQ ID NO: 33196 - DNA, 18 bp, Homo sapiens
gggctgggacggacaccc

SEQ ID NO: 33197 - DNA, 19 bp, Homo sapiens
gggctgggacggacacccg

SEQ ID NO: 33198 - DNA, 17 bp, Homo sapiens
gctgggacggacacccg

SEQ ID NO: 33199 - DNA, 16 bp, Homo sapiens
ctgggacggacacccg

SEQ ID NO: 33200 - DNA, 16 bp, Homo sapiens
gctctgtagcagaaac

SEQ ID NO: 33201 - DNA, 17 bp, Homo sapiens
tgctctgtagcagaaac

SEQ ID NO: 33202 - DNA, 18 bp, Homo sapiens
gtgctctgtagcagaaac

SEQ ID NO: 33203 - DNA, 20 bp, Homo sapiens
aggtgctctgtagcagaaac

SEQ ID NO: 33204 - DNA, 21 bp, Homo sapiens
gaggtgctctgtagcagaaac

SEQ ID NO: 33205 - DNA, 23 bp, Homo sapiens
aggaggtgctctgtagcagaaac

SEQ ID NO: 33206 - DNA, 18 bp, Homo sapiens
aggtgctctgtagcagaa

SEQ ID NO: 33207 - DNA, 17 bp, Homo sapiens
ggaggtgctctgtagca

SEQ ID NO: 33208 - DNA, 19 bp, Homo sapiens
gaggaggtgctctgtagca

SEQ ID NO: 33209 - DNA, 27 bp, Homo sapiens
tcgttgaagaggaggtgctctgtagca

SEQ ID NO: 33210 - DNA, 21 bp, Homo sapiens
gaagaggaggtgctctgtagc

SEQ ID NO: 33211 - DNA, 22 bp, Homo sapiens
tgaagaggaggtgctctgtagc

SEQ ID NO: 33212 - DNA, 25 bp, Homo sapiens
cgttgaagaggaggtgctctgtagc

SEQ ID NO: 33213 - DNA, 26 bp, Homo sapiens
tcgttgaagaggaggtgctctgtagc

SEQ ID NO: 33214 - DNA, 19 bp, Homo sapiens
aagaggaggtgctctgtag

SEQ ID NO: 33215 - DNA, 22 bp, Homo sapiens
ttgaagaggaggtgctctgtag

SEQ ID NO: 33216 - DNA, 20 bp, Homo sapiens
ttgaagaggaggtgctctgt

SEQ ID NO: 33217 - DNA, 26 bp, Homo sapiens
gattcgttgaagaggaggtgctctgt

SEQ ID NO: 33218 - DNA, 19 bp, Homo sapiens
ttgaagaggaggtgctctg

SEQ ID NO: 33219 - DNA, 18 bp, Homo sapiens
ttgaagaggaggtgctct

SEQ ID NO: 33220 - DNA, 23 bp, Homo sapiens
gattcgttgaagaggaggtgctc

SEQ ID NO: 33221 - DNA, 22 bp, Homo sapiens
gattcgttgaagaggaggtgct

SEQ ID NO: 33222 - DNA, 21 bp, Homo sapiens
gattcgttgaagaggaggtgc

SEQ ID NO: 33223 - DNA, 20 bp, Homo sapiens
gattcgttgaagaggaggtg

SEQ ID NO: 33224 - DNA, 17 bp, Homo sapiens
gattcgttgaagaggag

SEQ ID NO: 33225 - DNA, 23 bp, Homo sapiens
agtgacttgctctccaatggtat

SEQ ID NO: 33226 - DNA, 25 bp, Homo sapiens
acagtgacttgctctccaatggtat

SEQ ID NO: 33227 - DNA, 26 bp, Homo sapiens
aacagtgacttgctctccaatggtat

SEQ ID NO: 33228 - DNA, 27 bp, Homo sapiens
caacagtgacttgctctccaatggtat

SEQ ID NO: 33229 - DNA, 28 bp, Homo sapiens
acaacagtgacttgctctccaatggtat

SEQ ID NO: 33230 - DNA, 19 bp, Homo sapiens
gacttgctctccaatggta

SEQ ID NO: 33231 - DNA, 24 bp, Homo sapiens
acagtgacttgctctccaatggta

SEQ ID NO: 33232 - DNA, 27 bp, Homo sapiens
acaacagtgacttgctctccaatggta

SEQ ID NO: 33233 - DNA, 28 bp, Homo sapiens
aacaacagtgacttgctctccaatggta

SEQ ID NO: 33234 - DNA, 24 bp, Homo sapiens
aacagtgacttgctctccaatggt

SEQ ID NO: 33235 - DNA, 23 bp, Homo sapiens
aacagtgacttgctctccaatgg

SEQ ID NO: 33236 - DNA, 27 bp, Homo sapiens
caacaacagtgacttgctctccaatgg

SEQ ID NO: 33237 - DNA, 22 bp, Homo sapiens
aacagtgacttgctctccaatg

SEQ ID NO: 33238 - DNA, 24 bp, Homo sapiens
acaacagtgacttgctctccaatg

SEQ ID NO: 33239 - DNA, 20 bp, Homo sapiens
acagtgacttgctctccaat

SEQ ID NO: 33240 - DNA, 21 bp, Homo sapiens
aacagtgacttgctctccaat

SEQ ID NO: 33241 - DNA, 22 bp, Homo sapiens
caacagtgacttgctctccaat

SEQ ID NO: 33242 - DNA, 23 bp, Homo sapiens
acaacagtgacttgctctccaat

SEQ ID NO: 33243 - DNA, 21 bp, Homo sapiens
acaacagtgacttgctctcca

SEQ ID NO: 33244 - DNA, 20 bp, Homo sapiens
acaacagtgacttgctctcc

SEQ ID NO: 33245 - DNA, 19 bp, Homo sapiens
acaacagtgacttgctctc

SEQ ID NO: 33246 - DNA, 23 bp, Homo sapiens
agctcatcccacctctgccacca

SEQ ID NO: 33247 - DNA, 21 bp, Homo sapiens
tcatcccacctctgccaccaa

SEQ ID NO: 33248 - DNA, 20 bp, Homo sapiens
catcccacctctgccaccaa

SEQ ID NO: 33249 - DNA, 20 bp, Homo sapiens
atcccacctctgccaccaaa

SEQ ID NO: 33250 - DNA, 21 bp, Homo sapiens
atcccacctctgccaccaaaa

SEQ ID NO: 33251 - DNA, 22 bp, Homo sapiens
atcccacctctgccaccaaaac

SEQ ID NO: 33252 - DNA, 23 bp, Homo sapiens
atcccacctctgccaccaaaaca

SEQ ID NO: 33253 - DNA, 20 bp, Homo sapiens
tcccacctctgccaccaaaa

SEQ ID NO: 33254 - DNA, 16 bp, Homo sapiens
tctgaggcaagtggtc

SEQ ID NO: 33255 - DNA, 23 bp, Homo sapiens
aaatgggtggtctgaggcaagtg

SEQ ID NO: 33256 - DNA, 22 bp, Homo sapiens
aaatgggtggtctgaggcaagt

SEQ ID NO: 33257 - DNA, 21 bp, Homo sapiens
aaatgggtggtctgaggcaag

SEQ ID NO: 33258 - DNA, 23 bp, Homo sapiens
aggaggaaataggcaggccaggg

SEQ ID NO: 33259 - DNA, 24 bp, Homo sapiens
aaggaggaaataggcaggccaggg

SEQ ID NO: 33260 - DNA, 22 bp, Homo sapiens
aggaggaaataggcaggccagg

SEQ ID NO: 33261 - DNA, 23 bp, Homo sapiens
aaggaggaaataggcaggccagg

SEQ ID NO: 33262 - DNA, 24 bp, Homo sapiens
aaaggaggaaataggcaggccagg

SEQ ID NO: 33263 - DNA, 21 bp, Homo sapiens
aggaggaaataggcaggccag

SEQ ID NO: 33264 - DNA, 22 bp, Homo sapiens
aaggaggaaataggcaggccag

SEQ ID NO: 33265 - DNA, 23 bp, Homo sapiens
aaaggaggaaataggcaggccag

SEQ ID NO: 33266 - DNA, 18 bp, Homo sapiens
gaggaaataggcaggcca

SEQ ID NO: 33267 - DNA, 19 bp, Homo sapiens
ggaggaaataggcaggcca

SEQ ID NO: 33268 - DNA, 21 bp, Homo sapiens
aaggaggaaataggcaggcca

SEQ ID NO: 33269 - DNA, 20 bp, Homo sapiens
aaggaggaaataggcaggcc

SEQ ID NO: 33270 - DNA, 21 bp, Homo sapiens
aaaggaggaaataggcaggcc

SEQ ID NO: 33271 - DNA, 19 bp, Homo sapiens
aaggaggaaataggcaggc

SEQ ID NO: 33272 - DNA, 18 bp, Homo sapiens
aaaggaggaaataggcag

SEQ ID NO: 33273 - DNA, 24 bp, Homo sapiens
ccctgcctgttttctcctttgtga

SEQ ID NO: 33274 - DNA, 24 bp, Homo sapiens
gccctgcctgttttctcctttgtg

SEQ ID NO: 33275 - DNA, 22 bp, Homo sapiens
ccctgcctgttttctcctttgt

SEQ ID NO: 33276 - DNA, 23 bp, Homo sapiens
gccctgcctgttttctcctttgt

SEQ ID NO: 33277 - DNA, 24 bp, Homo sapiens
tgccctgcctgttttctcctttgt

SEQ ID NO: 33278 - DNA, 21 bp, Homo sapiens
ccctgcctgttttctcctttg

SEQ ID NO: 33279 - DNA, 22 bp, Homo sapiens
gccctgcctgttttctcctttg

SEQ ID NO: 33280 - DNA, 23 bp, Homo sapiens
tgccctgcctgttttctcctttg

SEQ ID NO: 33281 - DNA, 19 bp, Homo sapiens
ccctgcctgttttctcctt

SEQ ID NO: 33282 - DNA, 21 bp, Homo sapiens
tgccctgcctgttttctcctt

SEQ ID NO: 33283 - DNA, 19 bp, Homo sapiens
gccctgcctgttttctcct

SEQ ID NO: 33284 - DNA, 20 bp, Homo sapiens
tgccctgcctgttttctcct

SEQ ID NO: 33285 - DNA, 22 bp, Homo sapiens
aacctgtctgtggaaaggagct

SEQ ID NO: 33286 - DNA, 25 bp, Homo sapiens
acctgtctgtggaaaggagctacct

SEQ ID NO: 33287 - DNA, 23 bp, Homo sapiens
aggagctatccactccaggtgtc

SEQ ID NO: 33288 - DNA, 19 bp, Homo sapiens
tgaaactgacacagttctg

SEQ ID NO: 33289 - DNA, 27 bp, Homo sapiens
cagcagggtgaaactgacacagttctg

SEQ ID NO: 33290 - DNA, 23 bp, Homo sapiens
cagggtgaaactgacacagttct

SEQ ID NO: 33291 - DNA, 26 bp, Homo sapiens
cagcagggtgaaactgacacagttct

SEQ ID NO: 33292 - DNA, 23 bp, Homo sapiens
agcagcagggtgaaactgacaca

SEQ ID NO: 33293 - DNA, 19 bp, Homo sapiens
gcagcagggtgaaactgac

SEQ ID NO: 33294 - DNA, 20 bp, Homo sapiens
ggaggagcagcagggtgaaa

SEQ ID NO: 33295 - DNA, 23 bp, Homo sapiens
gcggggctgggcgcgcggagcag

SEQ ID NO: 33296 - DNA, 19 bp, Homo sapiens
gggctgggcgcgcggagca

SEQ ID NO: 33297 - DNA, 23 bp, Homo sapiens
agcggggctgggcgcgcggagca

SEQ ID NO: 33298 - DNA, 18 bp, Homo sapiens
gggctgggcgcgcggagc

SEQ ID NO: 33299 - DNA, 20 bp, Homo sapiens
cggggctgggcgcgcggagc

SEQ ID NO: 33300 - DNA, 22 bp, Homo sapiens
agcggggctgggcgcgcggagc

SEQ ID NO: 33301 - DNA, 17 bp, Homo sapiens
gggctgggcgcgcggag

SEQ ID NO: 33302 - DNA, 16 bp, Homo sapiens
gggctgggcgcgcgga

SEQ ID NO: 33303 - DNA, 18 bp, Homo sapiens
cggggctgggcgcgcgga

SEQ ID NO: 33304 - DNA, 20 bp, Homo sapiens
agcggggctgggcgcgcgga

SEQ ID NO: 33305 - DNA, 21 bp, Homo sapiens
cagcggggctgggcgcgcgga

SEQ ID NO: 33306 - DNA, 18 bp, Homo sapiens
cagcggggctgggcgcgc

SEQ ID NO: 33307 - DNA, 17 bp, Homo sapiens
cagcggggctgggcgcg

SEQ ID NO: 33308 - DNA, 25 bp, Homo sapiens
caccttaactgcagccaattctaat

SEQ ID NO: 33309 - DNA, 22 bp, Homo sapiens
caccttaactgcagccaattct

SEQ ID NO: 33310 - DNA, 21 bp, Homo sapiens
caccttaactgcagccaattc

SEQ ID NO: 33311 - DNA, 20 bp, Homo sapiens
caccttaactgcagccaatt

SEQ ID NO: 33312 - DNA, 23 bp, Homo sapiens
tgccaccttaactgcagccaatt

SEQ ID NO: 33313 - DNA, 24 bp, Homo sapiens
gtgccaccttaactgcagccaatt

SEQ ID NO: 33314 - DNA, 22 bp, Homo sapiens
tgccaccttaactgcagccaat

SEQ ID NO: 33315 - DNA, 22 bp, Homo sapiens
gtgccaccttaactgcagccaa

SEQ ID NO: 33316 - DNA, 21 bp, Homo sapiens
gtgccaccttaactgcagcca

SEQ ID NO: 33317 - DNA, 26 bp, Homo sapiens
gttggctgcagttaaggtggctaatc

SEQ ID NO: 33318 - DNA, 24 bp, Homo sapiens
ttggctgcagttaaggtggctaat

SEQ ID NO: 33319 - DNA, 23 bp, Homo sapiens
gttggctgcagttaaggtggcta

SEQ ID NO: 33320 - DNA, 24 bp, Homo sapiens
aagttggctgcagttaaggtggct

SEQ ID NO: 33321 - DNA, 21 bp, Homo sapiens
gttggctgcagttaaggtggc

SEQ ID NO: 33322 - DNA, 22 bp, Homo sapiens
agttggctgcagttaaggtggc

SEQ ID NO: 33323 - DNA, 20 bp, Homo sapiens
gttggctgcagttaaggtgg

SEQ ID NO: 33324 - DNA, 19 bp, Homo sapiens
gttggctgcagttaaggtg

SEQ ID NO: 33325 - DNA, 18 bp, Homo sapiens
gaatgaaagttggctgca

SEQ ID NO: 33326 - DNA, 17 bp, Homo sapiens
gaatgaaagttggctgc

SEQ ID NO: 33327 - DNA, 19 bp, Homo sapiens
gacagcaaaggggtgctca

SEQ ID NO: 33328 - DNA, 23 bp, Homo sapiens
gcagggacagcaaaggggtgctc

SEQ ID NO: 33329 - DNA, 22 bp, Homo sapiens
gcagggacagcaaaggggtgct

SEQ ID NO: 33330 - DNA, 20 bp, Homo sapiens
gcagggacagcaaaggggtg

SEQ ID NO: 33331 - DNA, 25 bp, Homo sapiens
ttccctttgtcatccttcgcctagg

SEQ ID NO: 33332 - DNA, 24 bp, Homo sapiens
ttccctttgtcatccttcgcctag

SEQ ID NO: 33333 - DNA, 23 bp, Homo sapiens
ttccctttgtcatccttcgccta

SEQ ID NO: 33334 - DNA, 21 bp, Homo sapiens
ttccctttgtcatccttcgcc

SEQ ID NO: 33335 - DNA, 20 bp, Homo sapiens
ttccctttgtcatccttcgc

SEQ ID NO: 33336 - DNA, 19 bp, Homo sapiens
ttccctttgtcatccttcg

SEQ ID NO: 33337 - DNA, 25 bp, Homo sapiens
tttcagataacagtattacatcttt

SEQ ID NO: 33338 - DNA, 22 bp, Homo sapiens
ttcagataacagtattacatct

SEQ ID NO: 33339 - DNA, 23 bp, Homo sapiens
tttcagataacagtattacatct

SEQ ID NO: 33340 - DNA, 21 bp, Homo sapiens
ttcagataacagtattacatc

SEQ ID NO: 33341 - DNA, 22 bp, Homo sapiens
tttcagataacagtattacatc

SEQ ID NO: 33342 - DNA, 20 bp, Homo sapiens
tttcagataacagtattaca

SEQ ID NO: 33343 - DNA, 23 bp, Homo sapiens
gtatttcagataacagtattaca

SEQ ID NO: 33344 - DNA, 16 bp, Homo sapiens
tacctgaaataggctg

SEQ ID NO: 33345 - DNA, 25 bp, Homo sapiens
agcaatactgttacctgaaataggc

SEQ ID NO: 33346 - DNA, 23 bp, Homo sapiens
agcaatactgttacctgaaatag

SEQ ID NO: 33347 - DNA, 24 bp, Homo sapiens
aagcaatactgttacctgaaatag

SEQ ID NO: 33348 - DNA, 22 bp, Homo sapiens
agcaatactgttacctgaaata

SEQ ID NO: 33349 - DNA, 23 bp, Homo sapiens
aagcaatactgttacctgaaata

SEQ ID NO: 33350 - DNA, 20 bp, Homo sapiens
gcaatactgttacctgaaat

SEQ ID NO: 33351 - DNA, 21 bp, Homo sapiens
agcaatactgttacctgaaat

SEQ ID NO: 33352 - DNA, 20 bp, Homo sapiens
agcaatactgttacctgaaa

SEQ ID NO: 33353 - DNA, 21 bp, Homo sapiens
aagcaatactgttacctgaaa

SEQ ID NO: 33354 - DNA, 19 bp, Homo sapiens
agcaatactgttacctgaa

SEQ ID NO: 33355 - DNA, 20 bp, Homo sapiens
aagcaatactgttacctgaa

SEQ ID NO: 33356 - DNA, 21 bp, Homo sapiens
gaagcaatactgttacctgaa

SEQ ID NO: 33357 - DNA, 19 bp, Homo sapiens
aagcaatactgttacctga

SEQ ID NO: 33358 - DNA, 17 bp, Homo sapiens
tgagggagtaggatgta

SEQ ID NO: 33359 - DNA, 18 bp, Homo sapiens
tgagggagtaggatgtat

SEQ ID NO: 33360 - DNA, 19 bp, Homo sapiens
tgagggagtaggatgtatg

SEQ ID NO: 33361 - DNA, 20 bp, Homo sapiens
tgagggagtaggatgtatgg

SEQ ID NO: 33362 - DNA, 21 bp, Homo sapiens
tgagggagtaggatgtatggt

SEQ ID NO: 33363 - DNA, 23 bp, Homo sapiens
tgagggagtaggatgtatggttg

SEQ ID NO: 33364 - DNA, 24 bp, Homo sapiens
tgagggagtaggatgtatggttgt

SEQ ID NO: 33365 - DNA, 16 bp, Homo sapiens
aggagtcggggcttta

SEQ ID NO: 33366 - DNA, 17 bp, Homo sapiens
gatctcagctgtctgaa

SEQ ID NO: 33367 - DNA, 21 bp, Homo sapiens
ctcagctgtctgaaaatgtct

SEQ ID NO: 33368 - DNA, 23 bp, Homo sapiens
tgcagcattcatgtcccaccccc

SEQ ID NO: 33369 - DNA, 22 bp, Homo sapiens
tgcagcattcatgtcccacccc

SEQ ID NO: 33370 - DNA, 21 bp, Homo sapiens
tgcagcattcatgtcccaccc

SEQ ID NO: 33371 - DNA, 18 bp, Homo sapiens
tgcagcattcatgtccca

SEQ ID NO: 33372 - DNA, 17 bp, Homo sapiens
acattgcagcattcatg

SEQ ID NO: 33373 - DNA, 23 bp, Homo sapiens
tcttttctttgagactcactacc

SEQ ID NO: 33374 - DNA, 24 bp, Homo sapiens
ctcttttctttgagactcactacc

SEQ ID NO: 33375 - DNA, 25 bp, Homo sapiens
cctcttttctttgagactcactacc

SEQ ID NO: 33376 - DNA, 26 bp, Homo sapiens
tcctcttttctttgagactcactacc

SEQ ID NO: 33377 - DNA, 22 bp, Homo sapiens
tcttttctttgagactcactac

SEQ ID NO: 33378 - DNA, 23 bp, Homo sapiens
ctcttttctttgagactcactac

SEQ ID NO: 33379 - DNA, 24 bp, Homo sapiens
cctcttttctttgagactcactac

SEQ ID NO: 33380 - DNA, 21 bp, Homo sapiens
tcttttctttgagactcacta

SEQ ID NO: 33381 - DNA, 22 bp, Homo sapiens
ctcttttctttgagactcacta

SEQ ID NO: 33382 - DNA, 24 bp, Homo sapiens
tcctcttttctttgagactcacta

SEQ ID NO: 33383 - DNA, 21 bp, Homo sapiens
ctcttttctttgagactcact

SEQ ID NO: 33384 - DNA, 22 bp, Homo sapiens
cctcttttctttgagactcact

SEQ ID NO: 33385 - DNA, 23 bp, Homo sapiens
tcctcttttctttgagactcact

SEQ ID NO: 33386 - DNA, 22 bp, Homo sapiens
tcctcttttctttgagactcac

SEQ ID NO: 33387 - DNA, 19 bp, Homo sapiens
ctcttttctttgagactca

SEQ ID NO: 33388 - DNA, 21 bp, Homo sapiens
tcctcttttctttgagactca

SEQ ID NO: 33389 - DNA, 27 bp, Homo sapiens
tgagtctctaagaaaagaggaggtggt

SEQ ID NO: 33390 - DNA, 25 bp, Homo sapiens
tgagtctctaagaaaagaggaggtg

SEQ ID NO: 33391 - DNA, 24 bp, Homo sapiens
tgagtctctaagaaaagaggaggt

SEQ ID NO: 33392 - DNA, 23 bp, Homo sapiens
tgagtctctaagaaaagaggagg

SEQ ID NO: 33393 - DNA, 24 bp, Homo sapiens
gtgagtctctaagaaaagaggagg

SEQ ID NO: 33394 - DNA, 22 bp, Homo sapiens
tgagtctctaagaaaagaggag

SEQ ID NO: 33395 - DNA, 23 bp, Homo sapiens
gtgagtctctaagaaaagaggag

SEQ ID NO: 33396 - DNA, 21 bp, Homo sapiens
tgagtctctaagaaaagagga

SEQ ID NO: 33397 - DNA, 21 bp, Homo sapiens
gtgagtctctaagaaaagagg

SEQ ID NO: 33398 - DNA, 20 bp, Homo sapiens
gtgagtctctaagaaaagag

SEQ ID NO: 33399 - DNA, 16 bp, Homo sapiens
acgctctagcggggat

SEQ ID NO: 33400 - DNA, 17 bp, Homo sapiens
acgctctagcggggatt

SEQ ID NO: 33401 - DNA, 18 bp, Homo sapiens
acgctctagcggggattc

SEQ ID NO: 33402 - DNA, 19 bp, Homo sapiens
acgctctagcggggattcc

SEQ ID NO: 33403 - DNA, 21 bp, Homo sapiens
acgctctagcggggattccaa

SEQ ID NO: 33404 - DNA, 22 bp, Homo sapiens
acgctctagcggggattccaat

SEQ ID NO: 33405 - DNA, 22 bp, Homo sapiens
cgctctagcggggattccaata

SEQ ID NO: 33406 - DNA, 22 bp, Homo sapiens
tctagcggggattccaatattg

SEQ ID NO: 33407 - DNA, 20 bp, Homo sapiens
ctagcggggattccaatatt

SEQ ID NO: 33408 - DNA, 21 bp, Homo sapiens
ctagcggggattccaatattg

SEQ ID NO: 33409 - DNA, 22 bp, Homo sapiens
ctagcggggattccaatattgg

SEQ ID NO: 33410 - DNA, 21 bp, Homo sapiens
agcggggattccaatattggg

SEQ ID NO: 33411 - DNA, 19 bp, Homo sapiens
caatgttggaatcctcgct

SEQ ID NO: 33412 - DNA, 21 bp, Homo sapiens
caatgttggaatcctcgctag

SEQ ID NO: 33413 - DNA, 22 bp, Homo sapiens
caatgttggaatcctcgctaga

SEQ ID NO: 33414 - DNA, 23 bp, Homo sapiens
caatgttggaatcctcgctagag

SEQ ID NO: 33415 - DNA, 24 bp, Homo sapiens
caatgttggaatcctcgctagagc

SEQ ID NO: 33416 - DNA, 17 bp, Homo sapiens
aatgttggaatcctcgc

SEQ ID NO: 33417 - DNA, 20 bp, Homo sapiens
aatgttggaatcctcgctag

SEQ ID NO: 33418 - DNA, 21 bp, Homo sapiens
aatgttggaatcctcgctaga

SEQ ID NO: 33419 - DNA, 23 bp, Homo sapiens
aatgttggaatcctcgctagagc

SEQ ID NO: 33420 - DNA, 22 bp, Homo sapiens
atgttggaatcctcgctagagc

SEQ ID NO: 33421 - DNA, 24 bp, Homo sapiens
atgttggaatcctcgctagagcgt

SEQ ID NO: 33422 - DNA, 19 bp, Homo sapiens
tgttggaatcctcgctaga

SEQ ID NO: 33423 - DNA, 22 bp, Homo sapiens
tgttggaatcctcgctagagcg

SEQ ID NO: 33424 - DNA, 23 bp, Homo sapiens
tgttggaatcctcgctagagcgt

SEQ ID NO: 33425 - DNA, 22 bp, Homo sapiens
gttggaatcctcgctagagcgt

SEQ ID NO: 33426 - DNA, 22 bp, Homo sapiens
ttggaatcctcgctagagcgtg

SEQ ID NO: 33427 - DNA, 23 bp, Homo sapiens
ttggaatcctcgctagagcgtgc

SEQ ID NO: 33428 - DNA, 21 bp, Homo sapiens
gaatcctcgctagagcgtgca

SEQ ID NO: 33429 - DNA, 20 bp, Homo sapiens
aatcctcgctagagcgtgca

SEQ ID NO: 33430 - DNA, 19 bp, Homo sapiens
atcctcgctagagcgtgca

SEQ ID NO: 33431 - DNA, 17 bp, Homo sapiens
cctcgctagagcgtgca

SEQ ID NO: 33432 - DNA, 17 bp, Homo sapiens
agtgtgcggaaatgctt

SEQ ID NO: 33433 - DNA, 20 bp, Homo sapiens
agtgtgcggaaatgcttctg

SEQ ID NO: 33434 - DNA, 21 bp, Homo sapiens
agtgtgcggaaatgcttctgc

SEQ ID NO: 33435 - DNA, 22 bp, Homo sapiens
agtgtgcggaaatgcttctgct

SEQ ID NO: 33436 - DNA, 23 bp, Homo sapiens
agtgtgcggaaatgcttctgcta

SEQ ID NO: 33437 - DNA, 16 bp, Homo sapiens
gtgtgcggaaatgctt

SEQ ID NO: 33438 - DNA, 18 bp, Homo sapiens
gtgtgcggaaatgcttct

SEQ ID NO: 33439 - DNA, 19 bp, Homo sapiens
gtgtgcggaaatgcttctg

SEQ ID NO: 33440 - DNA, 20 bp, Homo sapiens
gtgtgcggaaatgcttctgc

SEQ ID NO: 33441 - DNA, 21 bp, Homo sapiens
gtgtgcggaaatgcttctgct

SEQ ID NO: 33442 - DNA, 23 bp, Homo sapiens
gtgtgcggaaatgcttctgctac

SEQ ID NO: 33443 - DNA, 24 bp, Homo sapiens
gtgtgcggaaatgcttctgctaca

SEQ ID NO: 33444 - DNA, 25 bp, Homo sapiens
gtgtgcggaaatgcttctgctacat

SEQ ID NO: 33445 - DNA, 26 bp, Homo sapiens
gtgtgcggaaatgcttctgctacatt

SEQ ID NO: 33446 - DNA, 20 bp, Homo sapiens
tgtgcggaaatgcttctgct

SEQ ID NO: 33447 - DNA, 25 bp, Homo sapiens
tgtgcggaaatgcttctgctacatt

SEQ ID NO: 33448 - DNA, 18 bp, Homo sapiens
gaaacatggagacaaagt

SEQ ID NO: 33449 - DNA, 23 bp, Homo sapiens
tccatgtttccttcccccttctg

SEQ ID NO: 33450 - DNA, 20 bp, Homo sapiens
catgtttccttcccccttct

SEQ ID NO: 33451 - DNA, 23 bp, Homo sapiens
ctccatgtttccttcccccttct

SEQ ID NO: 33452 - DNA, 24 bp, Homo sapiens
tctccatgtttccttcccccttct

SEQ ID NO: 33453 - DNA, 18 bp, Homo sapiens
tttgtctccatgtttcct

SEQ ID NO: 33454 - DNA, 17 bp, Homo sapiens
tttgtctccatgtttcc

SEQ ID NO: 33455 - DNA, 16 bp, Homo sapiens
tttgtctccatgtttc

SEQ ID NO: 33456 - DNA, 21 bp, Homo sapiens
caggattccagtacaggtctc

SEQ ID NO: 33457 - DNA, 21 bp, Homo sapiens
ttccagtacaggtctctcatt

SEQ ID NO: 33458 - DNA, 23 bp, Homo sapiens
ttccagtacaggtctctcatttc

SEQ ID NO: 33459 - DNA, 28 bp, Homo sapiens
ttccagtacaggtctctcatttccttca

SEQ ID NO: 33460 - DNA, 20 bp, Homo sapiens
tccagtacaggtctctcatt

SEQ ID NO: 33461 - DNA, 21 bp, Homo sapiens
tccagtacaggtctctcattt

SEQ ID NO: 33462 - DNA, 21 bp, Homo sapiens
ccagtacaggtctctcatttc

SEQ ID NO: 33463 - DNA, 22 bp, Homo sapiens
ccagtacaggtctctcatttcc

SEQ ID NO: 33464 - DNA, 23 bp, Homo sapiens
ccagtacaggtctctcatttcct

SEQ ID NO: 33465 - DNA, 22 bp, Homo sapiens
tacaggtctctcatttccttca

SEQ ID NO: 33466 - DNA, 19 bp, Homo sapiens
tttgaaatgagagacctgt

SEQ ID NO: 33467 - DNA, 21 bp, Homo sapiens
tgaaatgagagacctgtactg

SEQ ID NO: 33468 - DNA, 22 bp, Homo sapiens
tgaaatgagagacctgtactgt

SEQ ID NO: 33469 - DNA, 25 bp, Homo sapiens
tgaaatgagagacctgtactgtatc

SEQ ID NO: 33470 - DNA, 24 bp, Homo sapiens
gaaatgagagacctgtactgtatc

SEQ ID NO: 33471 - DNA, 21 bp, Homo sapiens
aaatgagagacctgtactgta

SEQ ID NO: 33472 - DNA, 22 bp, Homo sapiens
aaatgagagacctgtactgtat

SEQ ID NO: 33473 - DNA, 23 bp, Homo sapiens
aaatgagagacctgtactgtatc

SEQ ID NO: 33474 - DNA, 23 bp, Homo sapiens
aatgagagacctgtactgtatct

SEQ ID NO: 33475 - DNA, 17 bp, Homo sapiens
ctgtactgtatctgtta

SEQ ID NO: 33476 - DNA, 19 bp, Homo sapiens
tttctcccactaccaggct

SEQ ID NO: 33477 - DNA, 20 bp, Homo sapiens
tttctcccactaccaggctc

SEQ ID NO: 33478 - DNA, 21 bp, Homo sapiens
tttctcccactaccaggctcc

SEQ ID NO: 33479 - DNA, 22 bp, Homo sapiens
tttctcccactaccaggctccc

SEQ ID NO: 33480 - DNA, 24 bp, Homo sapiens
tttctcccactaccaggctcccat

SEQ ID NO: 33481 - DNA, 19 bp, Homo sapiens
ttctcccactaccaggctc

SEQ ID NO: 33482 - DNA, 20 bp, Homo sapiens
ttctcccactaccaggctcc

SEQ ID NO: 33483 - DNA, 21 bp, Homo sapiens
ttctcccactaccaggctccc

SEQ ID NO: 33484 - DNA, 23 bp, Homo sapiens
ttctcccactaccaggctcccat

SEQ ID NO: 33485 - DNA, 24 bp, Homo sapiens
ttctcccactaccaggctcccata

SEQ ID NO: 33486 - DNA, 22 bp, Homo sapiens
tctcccactaccaggctcccat

SEQ ID NO: 33487 - DNA, 19 bp, Homo sapiens
tgggatccagacagtggga

SEQ ID NO: 33488 - DNA, 20 bp, Homo sapiens
tgggatccagacagtgggag

SEQ ID NO: 33489 - DNA, 21 bp, Homo sapiens
tgggatccagacagtgggaga

SEQ ID NO: 33490 - DNA, 21 bp, Homo sapiens
ggatccagacagtgggagaaa

SEQ ID NO: 33491 - DNA, 22 bp, Homo sapiens
ggatccagacagtgggagaaaa

SEQ ID NO: 33492 - DNA, 17 bp, Homo sapiens
gatccagacagtgggag

SEQ ID NO: 33493 - DNA, 22 bp, Homo sapiens
gatccagacagtgggagaaaaa

SEQ ID NO: 33494 - DNA, 21 bp, Homo sapiens
tgtgaccctagaataattacc

SEQ ID NO: 33495 - DNA, 25 bp, Homo sapiens
ctgttctatgccctgagggacactg

SEQ ID NO: 33496 - DNA, 24 bp, Homo sapiens
ccctgttctatgccctgagggaca

SEQ ID NO: 33497 - DNA, 23 bp, Homo sapiens
ccctgttctatgccctgagggac

SEQ ID NO: 33498 - DNA, 24 bp, Homo sapiens
gccctgttctatgccctgagggac

SEQ ID NO: 33499 - DNA, 21 bp, Homo sapiens
ccctgttctatgccctgaggg

SEQ ID NO: 33500 - DNA, 20 bp, Homo sapiens
ccctgttctatgccctgagg

SEQ ID NO: 33501 - DNA, 20 bp, Homo sapiens
tgtagaacagggctgggatt

SEQ ID NO: 33502 - DNA, 28 bp, Homo sapiens
cctcagggctgtagaacagggctgggat

SEQ ID NO: 33503 - DNA, 27 bp, Homo sapiens
cctcagggctgtagaacagggctggga

SEQ ID NO: 33504 - DNA, 26 bp, Homo sapiens
cctcagggctgtagaacagggctggg

SEQ ID NO: 33505 - DNA, 25 bp, Homo sapiens
cctcagggctgtagaacagggctgg

SEQ ID NO: 33506 - DNA, 24 bp, Homo sapiens
cctcagggctgtagaacagggctg

SEQ ID NO: 33507 - DNA, 22 bp, Homo sapiens
ctcagggctgtagaacagggct

SEQ ID NO: 33508 - DNA, 22 bp, Homo sapiens
cctcagggctgtagaacagggc

SEQ ID NO: 33509 - DNA, 21 bp, Homo sapiens
cctcagggctgtagaacaggg

SEQ ID NO: 33510 - DNA, 20 bp, Homo sapiens
cctcagggctgtagaacagg

SEQ ID NO: 33511 - DNA, 19 bp, Homo sapiens
cctcagggctgtagaacag

SEQ ID NO: 33512 - DNA, 17 bp, Homo sapiens
cctcagggctgtagaac

SEQ ID NO: 33513 - DNA, 24 bp, Homo sapiens
tctagtaagagtggcagtcgaagg

SEQ ID NO: 33514 - DNA, 23 bp, Homo sapiens
tctagtaagagtggcagtcgaag

SEQ ID NO: 33515 - DNA, 24 bp, Homo sapiens
ttctagtaagagtggcagtcgaag

SEQ ID NO: 33516 - DNA, 22 bp, Homo sapiens
tctagtaagagtggcagtcgaa

SEQ ID NO: 33517 - DNA, 23 bp, Homo sapiens
ttctagtaagagtggcagtcgaa

SEQ ID NO: 33518 - DNA, 22 bp, Homo sapiens
ttctagtaagagtggcagtcga

SEQ ID NO: 33519 - DNA, 20 bp, Homo sapiens
tctagtaagagtggcagtcg

SEQ ID NO: 33520 - DNA, 19 bp, Homo sapiens
tctagtaagagtggcagtc

SEQ ID NO: 33521 - DNA, 20 bp, Homo sapiens
ttctagtaagagtggcagtc

SEQ ID NO: 33522 - DNA, 18 bp, Homo sapiens
tctagtaagagtggcagt

SEQ ID NO: 33523 - DNA, 19 bp, Homo sapiens
ttctagtaagagtggcagt

SEQ ID NO: 33524 - DNA, 18 bp, Homo sapiens
ttctagtaagagtggcag

SEQ ID NO: 33525 - DNA, 17 bp, Homo sapiens
ttctagtaagagtggca

SEQ ID NO: 33526 - DNA, 24 bp, Homo sapiens
atgctgacatatttactagagggt

SEQ ID NO: 33527 - DNA, 22 bp, Homo sapiens
tgctgacatatttactagaggg

SEQ ID NO: 33528 - DNA, 23 bp, Homo sapiens
atgctgacatatttactagaggg

SEQ ID NO: 33529 - DNA, 21 bp, Homo sapiens
atgctgacatatttactagag

SEQ ID NO: 33530 - DNA, 20 bp, Homo sapiens
atgctgacatatttactaga

SEQ ID NO: 33531 - DNA, 18 bp, Homo sapiens
atgctgacatatttacta

SEQ ID NO: 33532 - DNA, 19 bp, Homo sapiens
caaaagcatcaggaagtac

SEQ ID NO: 33533 - DNA, 20 bp, Homo sapiens
caaaagcatcaggaagtacc

SEQ ID NO: 33534 - DNA, 21 bp, Homo sapiens
caaaagcatcaggaagtaccc

SEQ ID NO: 33535 - DNA, 22 bp, Homo sapiens
caaaagcatcaggaagtaccca

SEQ ID NO: 33536 - DNA, 23 bp, Homo sapiens
caaaagcatcaggaagtacccac

SEQ ID NO: 33537 - DNA, 17 bp, Homo sapiens
aaaagcatcaggaagta

SEQ ID NO: 33538 - DNA, 19 bp, Homo sapiens
aaaagcatcaggaagtacc

SEQ ID NO: 33539 - DNA, 20 bp, Homo sapiens
aaaagcatcaggaagtaccc

SEQ ID NO: 33540 - DNA, 22 bp, Homo sapiens
aaaagcatcaggaagtacccac

SEQ ID NO: 33541 - DNA, 23 bp, Homo sapiens
aaaagcatcaggaagtacccacc

SEQ ID NO: 33542 - DNA, 25 bp, Homo sapiens
aagcatcaggaagtacccaccatgt

SEQ ID NO: 33543 - DNA, 24 bp, Homo sapiens
cctcccatgccaagaactcccaga

SEQ ID NO: 33544 - DNA, 23 bp, Homo sapiens
cctcccatgccaagaactcccag

SEQ ID NO: 33545 - DNA, 24 bp, Homo sapiens
tcctcccatgccaagaactcccag

SEQ ID NO: 33546 - DNA, 22 bp, Homo sapiens
cctcccatgccaagaactccca

SEQ ID NO: 33547 - DNA, 23 bp, Homo sapiens
tcctcccatgccaagaactccca

SEQ ID NO: 33548 - DNA, 26 bp, Homo sapiens
aagtcctcccatgccaagaactccca

SEQ ID NO: 33549 - DNA, 22 bp, Homo sapiens
tcctcccatgccaagaactccc

SEQ ID NO: 33550 - DNA, 23 bp, Homo sapiens
gtcctcccatgccaagaactccc

SEQ ID NO: 33551 - DNA, 20 bp, Homo sapiens
cctcccatgccaagaactcc

SEQ ID NO: 33552 - DNA, 21 bp, Homo sapiens
tcctcccatgccaagaactcc

SEQ ID NO: 33553 - DNA, 22 bp, Homo sapiens
gtcctcccatgccaagaactcc

SEQ ID NO: 33554 - DNA, 23 bp, Homo sapiens
agtcctcccatgccaagaactcc

SEQ ID NO: 33555 - DNA, 24 bp, Homo sapiens
aagtcctcccatgccaagaactcc

SEQ ID NO: 33556 - DNA, 20 bp, Homo sapiens
gtcctcccatgccaagaact

SEQ ID NO: 33557 - DNA, 22 bp, Homo sapiens
aagtcctcccatgccaagaact

SEQ ID NO: 33558 - DNA, 19 bp, Homo sapiens
gtcctcccatgccaagaac

SEQ ID NO: 33559 - DNA, 20 bp, Homo sapiens
aagtcctcccatgccaagaa

SEQ ID NO: 33560 - DNA, 26 bp, Homo sapiens
ggttcttagcataggaggtcttccca

SEQ ID NO: 33561 - DNA, 24 bp, Homo sapiens
ggttcttagcataggaggtcttcc

SEQ ID NO: 33562 - DNA, 20 bp, Homo sapiens
tcttagcataggaggtcttc

SEQ ID NO: 33563 - DNA, 21 bp, Homo sapiens
ttcttagcataggaggtcttc

SEQ ID NO: 33564 - DNA, 23 bp, Homo sapiens
ggttcttagcataggaggtcttc

SEQ ID NO: 33565 - DNA, 22 bp, Homo sapiens
ggttcttagcataggaggtctt

SEQ ID NO: 33566 - DNA, 23 bp, Homo sapiens
ggggttcttagcataggaggtct

SEQ ID NO: 33567 - DNA, 20 bp, Homo sapiens
ggttcttagcataggaggtc

SEQ ID NO: 33568 - DNA, 19 bp, Homo sapiens
ggttcttagcataggaggt

SEQ ID NO: 33569 - DNA, 18 bp, Homo sapiens
ggttcttagcataggagg

SEQ ID NO: 33570 - DNA, 17 bp, Homo sapiens
ggttcttagcataggag

SEQ ID NO: 33571 - DNA, 19 bp, Homo sapiens
ggtgggcttcccggagggc

SEQ ID NO: 33572 - DNA, 16 bp, Homo sapiens
aaacttagtcataaag

SEQ ID NO: 33573 - DNA, 17 bp, Homo sapiens
taaacttagtcataaag

SEQ ID NO: 33574 - DNA, 24 bp, Homo sapiens
gtgctgaaggggctgggggagcac

SEQ ID NO: 33575 - DNA, 19 bp, Homo sapiens
tgatatgtttgatatatta

SEQ ID NO: 33576 - DNA, 20 bp, Homo sapiens
tgatatgtttgatatattag

SEQ ID NO: 33577 - DNA, 21 bp, Homo sapiens
tgatatgtttgatatattagg

SEQ ID NO: 33578 - DNA, 23 bp, Homo sapiens
tgatatgtttgatatattaggtt

SEQ ID NO: 33579 - DNA, 24 bp, Homo sapiens
tgatatgtttgatatattaggttg

SEQ ID NO: 33580 - DNA, 25 bp, Homo sapiens
tgatatgtttgatatattaggttgt

SEQ ID NO: 33581 - DNA, 22 bp, Homo sapiens
gatatgtttgatatattaggtt

SEQ ID NO: 33582 - DNA, 19 bp, Homo sapiens
atgtttgatatattaggtt

SEQ ID NO: 33583 - DNA, 20 bp, Homo sapiens
atgtttgatatattaggttg

SEQ ID NO: 33584 - DNA, 19 bp, Homo sapiens
actatatatcaaacatatt

SEQ ID NO: 33585 - DNA, 20 bp, Homo sapiens
actatatatcaaacatattc

SEQ ID NO: 33586 - DNA, 21 bp, Homo sapiens
actatatatcaaacatattcc

SEQ ID NO: 33587 - DNA, 22 bp, Homo sapiens
actatatatcaaacatattcct

SEQ ID NO: 33588 - DNA, 23 bp, Homo sapiens
actatatatcaaacatattccta

SEQ ID NO: 33589 - DNA, 24 bp, Homo sapiens
actatatatcaaacatattcctac

SEQ ID NO: 33590 - DNA, 22 bp, Homo sapiens
ctatatatcaaacatattccta

SEQ ID NO: 33591 - DNA, 23 bp, Homo sapiens
ctggacttagggtcagaaggcct

SEQ ID NO: 33592 - DNA, 23 bp, Homo sapiens
actggacttagggtcagaaggcc

SEQ ID NO: 33593 - DNA, 21 bp, Homo sapiens
actggacttagggtcagaagg

SEQ ID NO: 33594 - DNA, 17 bp, Homo sapiens
agaagcactggacttag

SEQ ID NO: 33595 - DNA, 23 bp, Homo sapiens
gatgatggcagcaaattctgaaa

SEQ ID NO: 33596 - DNA, 27 bp, Homo sapiens
cgatgatgatggcagcaaattctgaaa

SEQ ID NO: 33597 - DNA, 25 bp, Homo sapiens
gatgatgatggcagcaaattctgaa

SEQ ID NO: 33598 - DNA, 27 bp, Homo sapiens
gaagaactgttgcatttgccctgcact

SEQ ID NO: 33599 - DNA, 23 bp, Homo sapiens
aagaactgttgcatttgccctgc

SEQ ID NO: 33600 - DNA, 24 bp, Homo sapiens
gaagaactgttgcatttgccctgc

SEQ ID NO: 33601 - DNA, 21 bp, Homo sapiens
agaactgttgcatttgccctg

SEQ ID NO: 33602 - DNA, 22 bp, Homo sapiens
aagaactgttgcatttgccctg

SEQ ID NO: 33603 - DNA, 23 bp, Homo sapiens
gaagaactgttgcatttgccctg

SEQ ID NO: 33604 - DNA, 24 bp, Homo sapiens
agaagaactgttgcatttgccctg

SEQ ID NO: 33605 - DNA, 21 bp, Homo sapiens
gaagaactgttgcatttgccc

SEQ ID NO: 33606 - DNA, 27 bp, Homo sapiens
gggaaagaagaactgttgcatttgccc

SEQ ID NO: 33607 - DNA, 20 bp, Homo sapiens
gaagaactgttgcatttgcc

SEQ ID NO: 33608 - DNA, 24 bp, Homo sapiens
gggcctcactgtatcgcccaggct

SEQ ID NO: 33609 - DNA, 23 bp, Homo sapiens
agggcctcactgtatcgcccagg

SEQ ID NO: 33610 - DNA, 24 bp, Homo sapiens
cagggcctcactgtatcgcccagg

SEQ ID NO: 33611 - DNA, 22 bp, Homo sapiens
agggcctcactgtatcgcccag

SEQ ID NO: 33612 - DNA, 23 bp, Homo sapiens
cagggcctcactgtatcgcccag

SEQ ID NO: 33613 - DNA, 24 bp, Homo sapiens
acagggcctcactgtatcgcccag

SEQ ID NO: 33614 - DNA, 21 bp, Homo sapiens
cagggcctcactgtatcgccc

SEQ ID NO: 33615 - DNA, 20 bp, Homo sapiens
cagggcctcactgtatcgcc

SEQ ID NO: 33616 - DNA, 21 bp, Homo sapiens
acagggcctcactgtatcgcc

SEQ ID NO: 33617 - DNA, 19 bp, Homo sapiens
cagggcctcactgtatcgc

SEQ ID NO: 33618 - DNA, 17 bp, Homo sapiens
agggcctcactgtatcg

SEQ ID NO: 33619 - DNA, 18 bp, Homo sapiens
cagggcctcactgtatcg

SEQ ID NO: 33620 - DNA, 23 bp, Homo sapiens
atagtccgagtaacgtcggggca

SEQ ID NO: 33621 - DNA, 26 bp, Homo sapiens
gggatagtccgagtaacgtcggggca

SEQ ID NO: 33622 - DNA, 27 bp, Homo sapiens
cgggatagtccgagtaacgtcggggca

SEQ ID NO: 33623 - DNA, 25 bp, Homo sapiens
gggatagtccgagtaacgtcggggc

SEQ ID NO: 33624 - DNA, 28 bp, Homo sapiens
atcgggatagtccgagtaacgtcggggc

SEQ ID NO: 33625 - DNA, 21 bp, Homo sapiens
atagtccgagtaacgtcgggg

SEQ ID NO: 33626 - DNA, 20 bp, Homo sapiens
cgggatagtccgagtaacgt

SEQ ID NO: 33627 - DNA, 19 bp, Homo sapiens
cgggatagtccgagtaacg

SEQ ID NO: 33628 - DNA, 25 bp, Homo sapiens
tctcccaacgtaagcccagcccctc

SEQ ID NO: 33629 - DNA, 26 bp, Homo sapiens
ttctcccaacgtaagcccagcccctc

SEQ ID NO: 33630 - DNA, 22 bp, Homo sapiens
tctcccaacgtaagcccagccc

SEQ ID NO: 33631 - DNA, 24 bp, Homo sapiens
gttctcccaacgtaagcccagccc

SEQ ID NO: 33632 - DNA, 21 bp, Homo sapiens
tctcccaacgtaagcccagcc

SEQ ID NO: 33633 - DNA, 22 bp, Homo sapiens
ttctcccaacgtaagcccagcc

SEQ ID NO: 33634 - DNA, 23 bp, Homo sapiens
gttctcccaacgtaagcccagcc

SEQ ID NO: 33635 - DNA, 21 bp, Homo sapiens
ttctcccaacgtaagcccagc

SEQ ID NO: 33636 - DNA, 19 bp, Homo sapiens
tctcccaacgtaagcccag

SEQ ID NO: 33637 - DNA, 21 bp, Homo sapiens
gttctcccaacgtaagcccag

SEQ ID NO: 33638 - DNA, 20 bp, Homo sapiens
gttctcccaacgtaagccca

SEQ ID NO: 33639 - DNA, 18 bp, Homo sapiens
ttctcccaacgtaagccc

SEQ ID NO: 33640 - DNA, 19 bp, Homo sapiens
gttctcccaacgtaagccc

SEQ ID NO: 33641 - DNA, 18 bp, Homo sapiens
gttctcccaacgtaagcc

SEQ ID NO: 33642 - DNA, 17 bp, Homo sapiens
gttctcccaacgtaagc

SEQ ID NO: 33643 - DNA, 27 bp, Homo sapiens
tgggtttacgttgggagaacttttacg

SEQ ID NO: 33644 - DNA, 26 bp, Homo sapiens
tgggtttacgttgggagaacttttac

SEQ ID NO: 33645 - DNA, 25 bp, Homo sapiens
tgggtttacgttgggagaactttta

SEQ ID NO: 33646 - DNA, 24 bp, Homo sapiens
tgggtttacgttgggagaactttt

SEQ ID NO: 33647 - DNA, 23 bp, Homo sapiens
tgggtttacgttgggagaacttt

SEQ ID NO: 33648 - DNA, 22 bp, Homo sapiens
tgggtttacgttgggagaactt

SEQ ID NO: 33649 - DNA, 20 bp, Homo sapiens
tgggtttacgttgggagaac

SEQ ID NO: 33650 - DNA, 19 bp, Homo sapiens
tgggtttacgttgggagaa

SEQ ID NO: 33651 - DNA, 18 bp, Homo sapiens
tgggtttacgttgggaga

SEQ ID NO: 33652 - DNA, 16 bp, Homo sapiens
tgggtttacgttggga

SEQ ID NO: 33653 - DNA, 18 bp, Homo sapiens
tgacctagtattctgtac

SEQ ID NO: 33654 - DNA, 19 bp, Homo sapiens
tgacctagtattctgtacc

SEQ ID NO: 33655 - DNA, 21 bp, Homo sapiens
tgacctagtattctgtaccag

SEQ ID NO: 33656 - DNA, 26 bp, Homo sapiens
atcctctttcgtccttcccactccag

SEQ ID NO: 33657 - DNA, 24 bp, Homo sapiens
tcctctttcgtccttcccactcca

SEQ ID NO: 33658 - DNA, 25 bp, Homo sapiens
atcctctttcgtccttcccactcca

SEQ ID NO: 33659 - DNA, 23 bp, Homo sapiens
tcctctttcgtccttcccactcc

SEQ ID NO: 33660 - DNA, 24 bp, Homo sapiens
atcctctttcgtccttcccactcc

SEQ ID NO: 33661 - DNA, 22 bp, Homo sapiens
tcctctttcgtccttcccactc

SEQ ID NO: 33662 - DNA, 23 bp, Homo sapiens
atcctctttcgtccttcccactc

SEQ ID NO: 33663 - DNA, 24 bp, Homo sapiens
gatcctctttcgtccttcccactc

SEQ ID NO: 33664 - DNA, 24 bp, Homo sapiens
tgatcctctttcgtccttcccact

SEQ ID NO: 33665 - DNA, 21 bp, Homo sapiens
atcctctttcgtccttcccac

SEQ ID NO: 33666 - DNA, 23 bp, Homo sapiens
tgatcctctttcgtccttcccac

SEQ ID NO: 33667 - DNA, 20 bp, Homo sapiens
atcctctttcgtccttccca

SEQ ID NO: 33668 - DNA, 22 bp, Homo sapiens
tgatcctctttcgtccttccca

SEQ ID NO: 33669 - DNA, 21 bp, Homo sapiens
tgatcctctttcgtccttccc

SEQ ID NO: 33670 - DNA, 24 bp, Homo sapiens
tggggtaaggataggagggtcagg

SEQ ID NO: 33671 - DNA, 25 bp, Homo sapiens
ctggggtaaggataggagggtcagg

SEQ ID NO: 33672 - DNA, 23 bp, Homo sapiens
tggggtaaggataggagggtcag

SEQ ID NO: 33673 - DNA, 24 bp, Homo sapiens
ctggggtaaggataggagggtcag

SEQ ID NO: 33674 - DNA, 23 bp, Homo sapiens
ctggggtaaggataggagggtca

SEQ ID NO: 33675 - DNA, 21 bp, Homo sapiens
tggggtaaggataggagggtc

SEQ ID NO: 33676 - DNA, 22 bp, Homo sapiens
ctggggtaaggataggagggtc

SEQ ID NO: 33677 - DNA, 20 bp, Homo sapiens
tggggtaaggataggagggt

SEQ ID NO: 33678 - DNA, 21 bp, Homo sapiens
ctggggtaaggataggagggt

SEQ ID NO: 33679 - DNA, 19 bp, Homo sapiens
ctggggtaaggataggagg

SEQ ID NO: 33680 - DNA, 18 bp, Homo sapiens
ctggaggcccataagctg

SEQ ID NO: 33681 - DNA, 24 bp, Homo sapiens
agactgacggctggaggcccataa

SEQ ID NO: 33682 - DNA, 23 bp, Homo sapiens
agactgacggctggaggcccata

SEQ ID NO: 33683 - DNA, 21 bp, Homo sapiens
agactgacggctggaggccca

SEQ ID NO: 33684 - DNA, 20 bp, Homo sapiens
agactgacggctggaggccc

SEQ ID NO: 33685 - DNA, 19 bp, Homo sapiens
agactgacggctggaggcc

SEQ ID NO: 33686 - DNA, 21 bp, Homo sapiens
tggggagactgacggctggag

SEQ ID NO: 33687 - DNA, 20 bp, Homo sapiens
gtggggagactgacggctgg

SEQ ID NO: 33688 - DNA, 23 bp, Homo sapiens
tgcctctcctcttgcctgcagac

SEQ ID NO: 33689 - DNA, 22 bp, Homo sapiens
tgcctctcctcttgcctgcaga

SEQ ID NO: 33690 - DNA, 25 bp, Homo sapiens
tgctgcctctcctcttgcctgcaga

SEQ ID NO: 33691 - DNA, 21 bp, Homo sapiens
tgcctctcctcttgcctgcag

SEQ ID NO: 33692 - DNA, 23 bp, Homo sapiens
tgctgcctctcctcttgcctgca

SEQ ID NO: 33693 - DNA, 22 bp, Homo sapiens
tgctgcctctcctcttgcctgc

SEQ ID NO: 33694 - DNA, 20 bp, Homo sapiens
tgctgcctctcctcttgcct

SEQ ID NO: 33695 - DNA, 23 bp, Homo sapiens
gtcaggagctgaagcagctggaa

SEQ ID NO: 33696 - DNA, 25 bp, Homo sapiens
aagtcaggagctgaagcagctggaa

SEQ ID NO: 33697 - DNA, 26 bp, Homo sapiens
caagtcaggagctgaagcagctggaa

SEQ ID NO: 33698 - DNA, 22 bp, Homo sapiens
gtcaggagctgaagcagctgga

SEQ ID NO: 33699 - DNA, 24 bp, Homo sapiens
aagtcaggagctgaagcagctgga

SEQ ID NO: 33700 - DNA, 20 bp, Homo sapiens
tcaggagctgaagcagctgg

SEQ ID NO: 33701 - DNA, 22 bp, Homo sapiens
agtcaggagctgaagcagctgg

SEQ ID NO: 33702 - DNA, 23 bp, Homo sapiens
aagtcaggagctgaagcagctgg

SEQ ID NO: 33703 - DNA, 22 bp, Homo sapiens
aagtcaggagctgaagcagctg

SEQ ID NO: 33704 - DNA, 25 bp, Homo sapiens
tacaagtcaggagctgaagcagctg

SEQ ID NO: 33705 - DNA, 23 bp, Homo sapiens
acaagtcaggagctgaagcagct

SEQ ID NO: 33706 - DNA, 24 bp, Homo sapiens
tacaagtcaggagctgaagcagct

SEQ ID NO: 33707 - DNA, 22 bp, Homo sapiens
acaagtcaggagctgaagcagc

SEQ ID NO: 33708 - DNA, 23 bp, Homo sapiens
tacaagtcaggagctgaagcagc

SEQ ID NO: 33709 - DNA, 19 bp, Homo sapiens
aagtcaggagctgaagcag

SEQ ID NO: 33710 - DNA, 21 bp, Homo sapiens
acaagtcaggagctgaagcag

SEQ ID NO: 33711 - DNA, 19 bp, Homo sapiens
caagtcaggagctgaagca

SEQ ID NO: 33712 - DNA, 20 bp, Homo sapiens
acaagtcaggagctgaagca

SEQ ID NO: 33713 - DNA, 21 bp, Homo sapiens
tacaagtcaggagctgaagca

SEQ ID NO: 33714 - DNA, 19 bp, Homo sapiens
tacaagtcaggagctgaag

SEQ ID NO: 33715 - DNA, 17 bp, Homo sapiens
acaagtcaggagctgaa

SEQ ID NO: 33716 - DNA, 16 bp, Homo sapiens
ctggttagacctggcc

SEQ ID NO: 33717 - DNA, 21 bp, Homo sapiens
cagccccctggccccaaaccc

SEQ ID NO: 33718 - DNA, 18 bp, Homo sapiens
tggtatccgtttggggat

SEQ ID NO: 33719 - DNA, 19 bp, Homo sapiens
tggtatccgtttggggatg

SEQ ID NO: 33720 - DNA, 20 bp, Homo sapiens
tggtatccgtttggggatgg

SEQ ID NO: 33721 - DNA, 21 bp, Homo sapiens
tggtatccgtttggggatggt

SEQ ID NO: 33722 - DNA, 22 bp, Homo sapiens
tggtatccgtttggggatggtt

SEQ ID NO: 33723 - DNA, 22 bp, Homo sapiens
ttggacggagaactgataaggg

SEQ ID NO: 33724 - DNA, 24 bp, Homo sapiens
ttggacggagaactgataagggta

SEQ ID NO: 33725 - DNA, 18 bp, Homo sapiens
tggacggagaactgataa

SEQ ID NO: 33726 - DNA, 19 bp, Homo sapiens
tggacggagaactgataag

SEQ ID NO: 33727 - DNA, 20 bp, Homo sapiens
tggacggagaactgataagg

SEQ ID NO: 33728 - DNA, 21 bp, Homo sapiens
tggacggagaactgataaggg

SEQ ID NO: 33729 - DNA, 23 bp, Homo sapiens
tggacggagaactgataagggta

SEQ ID NO: 33730 - DNA, 24 bp, Homo sapiens
tggacggagaactgataagggtag

SEQ ID NO: 33731 - DNA, 26 bp, Homo sapiens
tggacggagaactgataagggtaggt

SEQ ID NO: 33732 - DNA, 22 bp, Homo sapiens
acggagaactgataagggtagg

SEQ ID NO: 33733 - DNA, 18 bp, Homo sapiens
ggttggggtgcaggggtc

SEQ ID NO: 33734 - DNA, 23 bp, Homo sapiens
gacaactatggatgagctcttaa

SEQ ID NO: 33735 - DNA, 22 bp, Homo sapiens
gacaactatggatgagctctta

SEQ ID NO: 33736 - DNA, 23 bp, Homo sapiens
tgacaactatggatgagctctta

SEQ ID NO: 33737 - DNA, 24 bp, Homo sapiens
gtgacaactatggatgagctctta

SEQ ID NO: 33738 - DNA, 22 bp, Homo sapiens
tgacaactatggatgagctctt

SEQ ID NO: 33739 - DNA, 23 bp, Homo sapiens
gtgacaactatggatgagctctt

SEQ ID NO: 33740 - DNA, 22 bp, Homo sapiens
gtgacaactatggatgagctct

SEQ ID NO: 33741 - DNA, 26 bp, Homo sapiens
tgtaacaggactggactcccggcagc

SEQ ID NO: 33742 - DNA, 23 bp, Homo sapiens
aacaggactggactcccggcagc

SEQ ID NO: 33743 - DNA, 22 bp, Homo sapiens
acaggactggactcccggcagc

SEQ ID NO: 33744 - DNA, 24 bp, Homo sapiens
acaggactggactcccggcagccc

SEQ ID NO: 33745 - DNA, 21 bp, Homo sapiens
caggactggactcccggcagc

SEQ ID NO: 33746 - DNA, 19 bp, Homo sapiens
aggactggactcccggcag

SEQ ID NO: 33747 - DNA, 20 bp, Homo sapiens
aggactggactcccggcagc

SEQ ID NO: 33748 - DNA, 21 bp, Homo sapiens
aggactggactcccggcagcc

SEQ ID NO: 33749 - DNA, 23 bp, Homo sapiens
aggactggactcccggcagcccc

SEQ ID NO: 33750 - DNA, 24 bp, Homo sapiens
aggactggactcccggcagcccca

SEQ ID NO: 33751 - DNA, 25 bp, Homo sapiens
aggactggactcccggcagccccag

SEQ ID NO: 33752 - DNA, 18 bp, Homo sapiens
tggactcccggcagcccc

SEQ ID NO: 33753 - DNA, 24 bp, Homo sapiens
ccgcggtgaagcgcctgtgctctg

SEQ ID NO: 33754 - DNA, 16 bp, Homo sapiens
tgaagcgcctgtgctc

SEQ ID NO: 33755 - DNA, 17 bp, Homo sapiens
tgaagcgcctgtgctct

SEQ ID NO: 33756 - DNA, 18 bp, Homo sapiens
tgaagcgcctgtgctctg

SEQ ID NO: 33757 - DNA, 19 bp, Homo sapiens
tgaagcgcctgtgctctgc

SEQ ID NO: 33758 - DNA, 20 bp, Homo sapiens
tgaagcgcctgtgctctgcc

SEQ ID NO: 33759 - DNA, 21 bp, Homo sapiens
tgaagcgcctgtgctctgccg

SEQ ID NO: 33760 - DNA, 22 bp, Homo sapiens
tgaagcgcctgtgctctgccga

SEQ ID NO: 33761 - DNA, 23 bp, Homo sapiens
tgaagcgcctgtgctctgccgag

SEQ ID NO: 33762 - DNA, 25 bp, Homo sapiens
tgaagcgcctgtgctctgccgagac

SEQ ID NO: 33763 - DNA, 16 bp, Homo sapiens
tctgccgagactgccg

SEQ ID NO: 33764 - DNA, 26 bp, Homo sapiens
taaagagccctgtggagacacctgga

SEQ ID NO: 33765 - DNA, 24 bp, Homo sapiens
taaagagccctgtggagacacctg

SEQ ID NO: 33766 - DNA, 23 bp, Homo sapiens
taaagagccctgtggagacacct

SEQ ID NO: 33767 - DNA, 22 bp, Homo sapiens
taaagagccctgtggagacacc

SEQ ID NO: 33768 - DNA, 21 bp, Homo sapiens
taaagagccctgtggagacac

SEQ ID NO: 33769 - DNA, 19 bp, Homo sapiens
taaagagccctgtggagac

SEQ ID NO: 33770 - DNA, 18 bp, Homo sapiens
taaagagccctgtggaga

SEQ ID NO: 33771 - DNA, 24 bp, Homo sapiens
tgcaaaagtaattgcggtctttgt

SEQ ID NO: 33772 - DNA, 22 bp, Homo sapiens
caaaagtaattgcggtctttgt

SEQ ID NO: 33773 - DNA, 23 bp, Homo sapiens
caaaagtaattgcggtctttgtc

SEQ ID NO: 33774 - DNA, 22 bp, Homo sapiens
aaagtaattgcggtctttgtca

SEQ ID NO: 33775 - DNA, 21 bp, Homo sapiens
aaaaccacaattactttttac

SEQ ID NO: 33776 - DNA, 20 bp, Homo sapiens
aaaccacaattactttttac

SEQ ID NO: 33777 - DNA, 19 bp, Homo sapiens
aaccacaattactttttac

SEQ ID NO: 33778 - DNA, 21 bp, Homo sapiens
aaccacaattactttttactg

SEQ ID NO: 33779 - DNA, 21 bp, Homo sapiens
agaagcattctttcattggtt

SEQ ID NO: 33780 - DNA, 22 bp, Homo sapiens
agaagcattctttcattggttg

SEQ ID NO: 33781 - DNA, 23 bp, Homo sapiens
agaagcattctttcattggttgg

SEQ ID NO: 33782 - DNA, 22 bp, Homo sapiens
gaagcattctttcattggttgg

SEQ ID NO: 33783 - DNA, 18 bp, Homo sapiens
aagcattctttcattggt

SEQ ID NO: 33784 - DNA, 19 bp, Homo sapiens
aagcattctttcattggtt

SEQ ID NO: 33785 - DNA, 20 bp, Homo sapiens
aagcattctttcattggttg

SEQ ID NO: 33786 - DNA, 22 bp, Homo sapiens
aagcattctttcattggttggt

SEQ ID NO: 33787 - DNA, 23 bp, Homo sapiens
aagcattctttcattggttggtg

SEQ ID NO: 33788 - DNA, 19 bp, Homo sapiens
agcattctttcattggttg

SEQ ID NO: 33789 - DNA, 25 bp, Homo sapiens
caacaaaatcactagtcttccagat

SEQ ID NO: 33790 - DNA, 26 bp, Homo sapiens
atctggaagactagtgattttgttgt

SEQ ID NO: 33791 - DNA, 20 bp, Homo sapiens
ctggaagactagtgattttg

SEQ ID NO: 33792 - DNA, 21 bp, Homo sapiens
ctggaagactagtgattttgt

SEQ ID NO: 33793 - DNA, 23 bp, Homo sapiens
caacaaaatcactagtcttccag

SEQ ID NO: 33794 - DNA, 23 bp, Homo sapiens
ctggaagactagtgattttgttg

SEQ ID NO: 33795 - DNA, 25 bp, Homo sapiens
ctggaagactagtgattttgttgtt

SEQ ID NO: 33796 - DNA, 27 bp, Homo sapiens
ctggaagactagtgattttgttgttgt

SEQ ID NO: 33797 - DNA, 28 bp, Homo sapiens
ctggaagactagtgattttgttgttgtc

SEQ ID NO: 33798 - DNA, 25 bp, Homo sapiens
tggaagactagtgattttgttgttg

SEQ ID NO: 33799 - DNA, 26 bp, Homo sapiens
tggaagactagtgattttgttgttgt

SEQ ID NO: 33800 - DNA, 27 bp, Homo sapiens
tggaagactagtgattttgttgttgtc

SEQ ID NO: 33801 - DNA, 28 bp, Homo sapiens
tggaagactagtgattttgttgttgtct

SEQ ID NO: 33802 - DNA, 24 bp, Homo sapiens
ggaagactagtgattttgttgttg

SEQ ID NO: 33803 - DNA, 26 bp, Homo sapiens
ggaagactagtgattttgttgttgtc

SEQ ID NO: 33804 - DNA, 19 bp, Homo sapiens
actagtgattttgttgttg

SEQ ID NO: 33805 - DNA, 18 bp, Homo sapiens
ctagtgattttgttgttg

SEQ ID NO: 33806 - DNA, 24 bp, Homo sapiens
aggtagactgggatttgttgttga

SEQ ID NO: 33807 - DNA, 23 bp, Homo sapiens
aggtagactgggatttgttgttg

SEQ ID NO: 33808 - DNA, 20 bp, Homo sapiens
acaacaaatcccagtctacc

SEQ ID NO: 33809 - DNA, 21 bp, Homo sapiens
aggtagactgggatttgttgt

SEQ ID NO: 33810 - DNA, 21 bp, Homo sapiens
acaacaaatcccagtctacct

SEQ ID NO: 33811 - DNA, 22 bp, Homo sapiens
acaacaaatcccagtctaccta

SEQ ID NO: 33812 - DNA, 23 bp, Homo sapiens
acaacaaatcccagtctacctaa

SEQ ID NO: 33813 - DNA, 25 bp, Homo sapiens
acaacaaatcccagtctacctaatg

SEQ ID NO: 33814 - DNA, 16 bp, Homo sapiens
caacaaatcccagtct

SEQ ID NO: 33815 - DNA, 20 bp, Homo sapiens
aggtagactgggatttgttg

SEQ ID NO: 33816 - DNA, 20 bp, Homo sapiens
caacaaatcccagtctacct

SEQ ID NO: 33817 - DNA, 21 bp, Homo sapiens
caacaaatcccagtctaccta

SEQ ID NO: 33818 - DNA, 24 bp, Homo sapiens
caacaaatcccagtctacctaatg

SEQ ID NO: 33819 - DNA, 25 bp, Homo sapiens
caacaaatcccagtctacctaatgg

SEQ ID NO: 33820 - DNA, 19 bp, Homo sapiens
aggtagactgggatttgtt

SEQ ID NO: 33821 - DNA, 25 bp, Homo sapiens
tgattgtcttcccccaccctcacag

SEQ ID NO: 33822 - DNA, 24 bp, Homo sapiens
tgattgtcttcccccaccctcaca

SEQ ID NO: 33823 - DNA, 22 bp, Homo sapiens
gattgtcttcccccaccctcac

SEQ ID NO: 33824 - DNA, 23 bp, Homo sapiens
tgattgtcttcccccaccctcac

SEQ ID NO: 33825 - DNA, 24 bp, Homo sapiens
ctgattgtcttcccccaccctcac

SEQ ID NO: 33826 - DNA, 21 bp, Homo sapiens
gattgtcttcccccaccctca

SEQ ID NO: 33827 - DNA, 23 bp, Homo sapiens
ctgattgtcttcccccaccctca

SEQ ID NO: 33828 - DNA, 21 bp, Homo sapiens
tgattgtcttcccccaccctc

SEQ ID NO: 33829 - DNA, 20 bp, Homo sapiens
tgattgtcttcccccaccct

SEQ ID NO: 33830 - DNA, 26 bp, Homo sapiens
cgggtgggagcagatcttattgagag

SEQ ID NO: 33831 - DNA, 25 bp, Homo sapiens
cgggtgggagcagatcttattgaga

SEQ ID NO: 33832 - DNA, 23 bp, Homo sapiens
cgggtgggagcagatcttattga

SEQ ID NO: 33833 - DNA, 22 bp, Homo sapiens
cgggtgggagcagatcttattg

SEQ ID NO: 33834 - DNA, 21 bp, Homo sapiens
cgggtgggagcagatcttatt

SEQ ID NO: 33835 - DNA, 23 bp, Homo sapiens
agcgggtgggagcagatcttatt

SEQ ID NO: 33836 - DNA, 23 bp, Homo sapiens
ctctttggttatctagctgtatg

SEQ ID NO: 33837 - DNA, 24 bp, Homo sapiens
ctctttggttatctagctgtatga

SEQ ID NO: 33838 - DNA, 21 bp, Homo sapiens
tctttggttatctagctgtat

SEQ ID NO: 33839 - DNA, 27 bp, Homo sapiens
tctttggttatctagctgtatgagtgc

SEQ ID NO: 33840 - DNA, 28 bp, Homo sapiens
tctttggttatctagctgtatgagtgcc

SEQ ID NO: 33841 - DNA, 22 bp, Homo sapiens
ctttggttatctagctgtatga

SEQ ID NO: 33842 - DNA, 22 bp, Homo sapiens
ttatctagctgtatgagtgcca

SEQ ID NO: 33843 - DNA, 17 bp, Homo sapiens
tagctgtatgagtgcca

SEQ ID NO: 33844 - DNA, 22 bp, Homo sapiens
gccgtcataaagctagataacc

SEQ ID NO: 33845 - DNA, 28 bp, Homo sapiens
ccgtcataaagctagataaccgaaagta

SEQ ID NO: 33846 - DNA, 16 bp, Homo sapiens
cgtcataaagctagat

SEQ ID NO: 33847 - DNA, 22 bp, Homo sapiens
cgtcataaagctagataaccga

SEQ ID NO: 33848 - DNA, 24 bp, Homo sapiens
ataaagctagataaccgaaagtag

SEQ ID NO: 33849 - DNA, 25 bp, Homo sapiens
ataaagctagataaccgaaagtaga

SEQ ID NO: 33850 - DNA, 26 bp, Homo sapiens
ataaagctagataaccgaaagtagaa

SEQ ID NO: 33851 - DNA, 27 bp, Homo sapiens
ataaagctagataaccgaaagtagaaa

SEQ ID NO: 33852 - DNA, 21 bp, Homo sapiens
taaagctagataaccgaaagt

SEQ ID NO: 33853 - DNA, 22 bp, Homo sapiens
taaagctagataaccgaaagta

SEQ ID NO: 33854 - DNA, 23 bp, Homo sapiens
taaagctagataaccgaaagtag

SEQ ID NO: 33855 - DNA, 24 bp, Homo sapiens
taaagctagataaccgaaagtaga

SEQ ID NO: 33856 - DNA, 25 bp, Homo sapiens
taaagctagataaccgaaagtagaa

SEQ ID NO: 33857 - DNA, 25 bp, Homo sapiens
atcagtgaatgccttgaacctaaca

SEQ ID NO: 33858 - DNA, 24 bp, Homo sapiens
atcagtgaatgccttgaacctaac

SEQ ID NO: 33859 - DNA, 23 bp, Homo sapiens
atcagtgaatgccttgaacctaa

SEQ ID NO: 33860 - DNA, 24 bp, Homo sapiens
aatcagtgaatgccttgaacctaa

SEQ ID NO: 33861 - DNA, 21 bp, Homo sapiens
tcagtgaatgccttgaaccta

SEQ ID NO: 33862 - DNA, 22 bp, Homo sapiens
atcagtgaatgccttgaaccta

SEQ ID NO: 33863 - DNA, 23 bp, Homo sapiens
aatcagtgaatgccttgaaccta

SEQ ID NO: 33864 - DNA, 20 bp, Homo sapiens
tcagtgaatgccttgaacct

SEQ ID NO: 33865 - DNA, 21 bp, Homo sapiens
atcagtgaatgccttgaacct

SEQ ID NO: 33866 - DNA, 20 bp, Homo sapiens
atcagtgaatgccttgaacc

SEQ ID NO: 33867 - DNA, 21 bp, Homo sapiens
aatcagtgaatgccttgaacc

SEQ ID NO: 33868 - DNA, 18 bp, Homo sapiens
atcagtgaatgccttgaa

SEQ ID NO: 33869 - DNA, 21 bp, Homo sapiens
ctaaatctgaaagtccaaaac

SEQ ID NO: 33870 - DNA, 22 bp, Homo sapiens
cctaaatctgaaagtccaaaac

SEQ ID NO: 33871 - DNA, 23 bp, Homo sapiens
tcctaaatctgaaagtccaaaac

SEQ ID NO: 33872 - DNA, 21 bp, Homo sapiens
tcctaaatctgaaagtccaaa

SEQ ID NO: 33873 - DNA, 20 bp, Homo sapiens
tcctaaatctgaaagtccaa

SEQ ID NO: 33874 - DNA, 19 bp, Homo sapiens
tcctaaatctgaaagtcca

SEQ ID NO: 33875 - DNA, 27 bp, Homo sapiens
tggactttttcagatttggggatattt

SEQ ID NO: 33876 - DNA, 26 bp, Homo sapiens
tggactttttcagatttggggatatt

SEQ ID NO: 33877 - DNA, 27 bp, Homo sapiens
ttggactttttcagatttggggatatt

SEQ ID NO: 33878 - DNA, 25 bp, Homo sapiens
tggactttttcagatttggggatat

SEQ ID NO: 33879 - DNA, 25 bp, Homo sapiens
ttggactttttcagatttggggata

SEQ ID NO: 33880 - DNA, 26 bp, Homo sapiens
tttggactttttcagatttggggata

SEQ ID NO: 33881 - DNA, 23 bp, Homo sapiens
tggactttttcagatttggggat

SEQ ID NO: 33882 - DNA, 25 bp, Homo sapiens
tttggactttttcagatttggggat

SEQ ID NO: 33883 - DNA, 22 bp, Homo sapiens
tggactttttcagatttgggga

SEQ ID NO: 33884 - DNA, 23 bp, Homo sapiens
ttggactttttcagatttgggga

SEQ ID NO: 33885 - DNA, 24 bp, Homo sapiens
tttggactttttcagatttgggga

SEQ ID NO: 33886 - DNA, 21 bp, Homo sapiens
tggactttttcagatttgggg

SEQ ID NO: 33887 - DNA, 21 bp, Homo sapiens
ttggactttttcagatttggg

SEQ ID NO: 33888 - DNA, 22 bp, Homo sapiens
tttggactttttcagatttggg

SEQ ID NO: 33889 - DNA, 21 bp, Homo sapiens
tttggactttttcagatttgg

SEQ ID NO: 33890 - DNA, 18 bp, Homo sapiens
tagtgagttagagatgca

SEQ ID NO: 33891 - DNA, 20 bp, Homo sapiens
tagtgagttagagatgcaga

SEQ ID NO: 33892 - DNA, 21 bp, Homo sapiens
tagtgagttagagatgcagag

SEQ ID NO: 33893 - DNA, 22 bp, Homo sapiens
tagtgagttagagatgcagagc

SEQ ID NO: 33894 - DNA, 24 bp, Homo sapiens
tagtgagttagagatgcagagccc

SEQ ID NO: 33895 - DNA, 25 bp, Homo sapiens
tagtgagttagagatgcagagccct

SEQ ID NO: 33896 - DNA, 26 bp, Homo sapiens
tagtgagttagagatgcagagccctg

SEQ ID NO: 33897 - DNA, 27 bp, Homo sapiens
tagtgagttagagatgcagagccctgg

SEQ ID NO: 33898 - DNA, 21 bp, Homo sapiens
agtgagttagagatgcagagc

SEQ ID NO: 33899 - DNA, 22 bp, Homo sapiens
agtgagttagagatgcagagcc

SEQ ID NO: 33900 - DNA, 23 bp, Homo sapiens
agtgagttagagatgcagagccc

SEQ ID NO: 33901 - DNA, 24 bp, Homo sapiens
agtgagttagagatgcagagccct

SEQ ID NO: 33902 - DNA, 20 bp, Homo sapiens
tgagttagagatgcagagcc

SEQ ID NO: 33903 - DNA, 19 bp, Homo sapiens
gagttagagatgcagagcc

SEQ ID NO: 33904 - DNA, 24 bp, Homo sapiens
aggagacatggtgggggccggtca

SEQ ID NO: 33905 - DNA, 25 bp, Homo sapiens
tgaggagacatggtgggggccggtc

SEQ ID NO: 33906 - DNA, 25 bp, Homo sapiens
ttgaggagacatggtgggggccggt

SEQ ID NO: 33907 - DNA, 24 bp, Homo sapiens
ttgaggagacatggtgggggccgg

SEQ ID NO: 33908 - DNA, 23 bp, Homo sapiens
ttgaggagacatggtgggggccg

SEQ ID NO: 33909 - DNA, 21 bp, Homo sapiens
ttgaggagacatggtgggggc

SEQ ID NO: 33910 - DNA, 20 bp, Homo sapiens
ttgaggagacatggtggggg

SEQ ID NO: 33911 - DNA, 19 bp, Homo sapiens
ttgaggagacatggtgggg

SEQ ID NO: 33912 - DNA, 18 bp, Homo sapiens
ttgaggagacatggtggg

SEQ ID NO: 33913 - DNA, 17 bp, Homo sapiens
ttgaggagacatggtgg

SEQ ID NO: 33914 - DNA, 18 bp, Homo sapiens
ggggggcggggagagaac

SEQ ID NO: 33915 - DNA, 23 bp, Homo sapiens
gggcggggagagaacgcagtgac

SEQ ID NO: 33916 - DNA, 23 bp, Homo sapiens
gcggggagagaacgcagtgacgt

SEQ ID NO: 33917 - DNA, 20 bp, Homo sapiens
cggggagagaacgcagtgac

SEQ ID NO: 33918 - DNA, 21 bp, Homo sapiens
cggggagagaacgcagtgacg

SEQ ID NO: 33919 - DNA, 23 bp, Homo sapiens
cggggagagaacgcagtgacgtc

SEQ ID NO: 33920 - DNA, 24 bp, Homo sapiens
cggggagagaacgcagtgacgtct

SEQ ID NO: 33921 - DNA, 26 bp, Homo sapiens
cggggagagaacgcagtgacgtctgg

SEQ ID NO: 33922 - DNA, 21 bp, Homo sapiens
ggggagagaacgcagtgacgt

SEQ ID NO: 33923 - DNA, 20 bp, Homo sapiens
gggagagaacgcagtgacgt

SEQ ID NO: 33924 - DNA, 18 bp, Homo sapiens
gagagaacgcagtgacgt

SEQ ID NO: 33925 - DNA, 17 bp, Homo sapiens
gagaacgcagtgacgtc

SEQ ID NO: 33926 - DNA, 17 bp, Homo sapiens
gaacgcagtgacgtctg

SEQ ID NO: 33927 - DNA, 20 bp, Homo sapiens
gaacgcagtgacgtctggcc

SEQ ID NO: 33928 - DNA, 19 bp, Homo sapiens
aacgcagtgacgtctggcc

SEQ ID NO: 33929 - DNA, 17 bp, Homo sapiens
cgcagtgacgtctggcc

SEQ ID NO: 33930 - DNA, 16 bp, Homo sapiens
gcagtgacgtctggcc

SEQ ID NO: 33931 - DNA, 22 bp, Homo sapiens
cgcgctcggcgcggggcgcggg

SEQ ID NO: 33932 - DNA, 24 bp, Homo sapiens
cgcgctcggcgcggggcgcgggct

SEQ ID NO: 33933 - DNA, 27 bp, Homo sapiens
gcgctcggcgcggggcgcgggctccgg

SEQ ID NO: 33934 - DNA, 17 bp, Homo sapiens
cgcggggcgcgggctcc

SEQ ID NO: 33935 - DNA, 22 bp, Homo sapiens
cgcggggcgcgggctccgggtt

SEQ ID NO: 33936 - DNA, 20 bp, Homo sapiens
aactctgaccccttaggttg

SEQ ID NO: 33937 - DNA, 21 bp, Homo sapiens
aactctgaccccttaggttga

SEQ ID NO: 33938 - DNA, 23 bp, Homo sapiens
aactctgaccccttaggttgatg

SEQ ID NO: 33939 - DNA, 24 bp, Homo sapiens
aactctgaccccttaggttgatgt

SEQ ID NO: 33940 - DNA, 19 bp, Homo sapiens
actctgaccccttaggttg

SEQ ID NO: 33941 - DNA, 20 bp, Homo sapiens
actctgaccccttaggttga

SEQ ID NO: 33942 - DNA, 21 bp, Homo sapiens
actctgaccccttaggttgat

SEQ ID NO: 33943 - DNA, 22 bp, Homo sapiens
actctgaccccttaggttgatg

SEQ ID NO: 33944 - DNA, 23 bp, Homo sapiens
actctgaccccttaggttgatgt

SEQ ID NO: 33945 - DNA, 24 bp, Homo sapiens
actctgaccccttaggttgatgtc

SEQ ID NO: 33946 - DNA, 16 bp, Homo sapiens
accaacctaggtggtc

SEQ ID NO: 33947 - DNA, 21 bp, Homo sapiens
accaacctaggtggtcagagt

SEQ ID NO: 33948 - DNA, 22 bp, Homo sapiens
accaacctaggtggtcagagtt

SEQ ID NO: 33949 - DNA, 23 bp, Homo sapiens
accaacctaggtggtcagagttg

SEQ ID NO: 33950 - DNA, 20 bp, Homo sapiens
ccaacctaggtggtcagagt

SEQ ID NO: 33951 - DNA, 21 bp, Homo sapiens
ccaacctaggtggtcagagtt

SEQ ID NO: 33952 - DNA, 23 bp, Homo sapiens
ccaacctaggtggtcagagttgg

SEQ ID NO: 33953 - DNA, 19 bp, Homo sapiens
caacctaggtggtcagagt

SEQ ID NO: 33954 - DNA, 21 bp, Homo sapiens
caacctaggtggtcagagttg

SEQ ID NO: 33955 - DNA, 22 bp, Homo sapiens
caacctaggtggtcagagttgg

SEQ ID NO: 33956 - DNA, 23 bp, Homo sapiens
caacctaggtggtcagagttggc

SEQ ID NO: 33957 - DNA, 24 bp, Homo sapiens
caacctaggtggtcagagttggcc

SEQ ID NO: 33958 - DNA, 20 bp, Homo sapiens
tcttctggcttgatgcacat

SEQ ID NO: 33959 - DNA, 23 bp, Homo sapiens
cgtgtcttctggcttgatgcaca

SEQ ID NO: 33960 - DNA, 21 bp, Homo sapiens
gtgtcttctggcttgatgcac

SEQ ID NO: 33961 - DNA, 21 bp, Homo sapiens
ctcgtgtcttctggcttgatg

SEQ ID NO: 33962 - DNA, 25 bp, Homo sapiens
tgcatcaggccagaagacatgagcc

SEQ ID NO: 33963 - DNA, 22 bp, Homo sapiens
tgcatcaggccagaagacatga

SEQ ID NO: 33964 - DNA, 21 bp, Homo sapiens
tgtgcatcaggccagaagaca

SEQ ID NO: 33965 - DNA, 18 bp, Homo sapiens
tgcatcaggccagaagac

SEQ ID NO: 33966 - DNA, 17 bp, Homo sapiens
tgcatcaggccagaaga

SEQ ID NO: 33967 - DNA, 22 bp, Homo sapiens
gtagctgtacctgaaaccaagc

SEQ ID NO: 33968 - DNA, 20 bp, Homo sapiens
agctgtacctgaaaccaagc

SEQ ID NO: 33969 - DNA, 22 bp, Homo sapiens
tcggggttttgagggcgagatg

SEQ ID NO: 33970 - DNA, 23 bp, Homo sapiens
tcggggttttgagggcgagatga

SEQ ID NO: 33971 - DNA, 16 bp, Homo sapiens
cggggttttgagggcg

SEQ ID NO: 33972 - DNA, 18 bp, Homo sapiens
cggggttttgagggcgag

SEQ ID NO: 33973 - DNA, 19 bp, Homo sapiens
cggggttttgagggcgaga

SEQ ID NO: 33974 - DNA, 20 bp, Homo sapiens
cggggttttgagggcgagat

SEQ ID NO: 33975 - DNA, 21 bp, Homo sapiens
cggggttttgagggcgagatg

SEQ ID NO: 33976 - DNA, 23 bp, Homo sapiens
cggggttttgagggcgagatgag

SEQ ID NO: 33977 - DNA, 24 bp, Homo sapiens
cggggttttgagggcgagatgagt

SEQ ID NO: 33978 - DNA, 21 bp, Homo sapiens
ggggttttgagggcgagatga

SEQ ID NO: 33979 - DNA, 18 bp, Homo sapiens
aactggccctcaaagtcc

SEQ ID NO: 33980 - DNA, 20 bp, Homo sapiens
aactggccctcaaagtcccg

SEQ ID NO: 33981 - DNA, 21 bp, Homo sapiens
aactggccctcaaagtcccgc

SEQ ID NO: 33982 - DNA, 23 bp, Homo sapiens
aactggccctcaaagtcccgctt

SEQ ID NO: 33983 - DNA, 24 bp, Homo sapiens
aactggccctcaaagtcccgcttt

SEQ ID NO: 33984 - DNA, 25 bp, Homo sapiens
aactggccctcaaagtcccgctttt

SEQ ID NO: 33985 - DNA, 19 bp, Homo sapiens
tgagggacttttgggggca

SEQ ID NO: 33986 - DNA, 24 bp, Homo sapiens
tgagggacttttgggggcagatgt

SEQ ID NO: 33987 - DNA, 28 bp, Homo sapiens
gagggacttttgggggcagatgtgtttc

SEQ ID NO: 33988 - DNA, 17 bp, Homo sapiens
agggacttttgggggca

SEQ ID NO: 33989 - DNA, 19 bp, Homo sapiens
agggacttttgggggcaga

SEQ ID NO: 33990 - DNA, 20 bp, Homo sapiens
agggacttttgggggcagat

SEQ ID NO: 33991 - DNA, 21 bp, Homo sapiens
agggacttttgggggcagatg

SEQ ID NO: 33992 - DNA, 22 bp, Homo sapiens
agggacttttgggggcagatgt

SEQ ID NO: 33993 - DNA, 24 bp, Homo sapiens
agggacttttgggggcagatgtgt

SEQ ID NO: 33994 - DNA, 25 bp, Homo sapiens
agggacttttgggggcagatgtgtt

SEQ ID NO: 33995 - DNA, 26 bp, Homo sapiens
agggacttttgggggcagatgtgttt

SEQ ID NO: 33996 - DNA, 27 bp, Homo sapiens
agggacttttgggggcagatgtgtttc

SEQ ID NO: 33997 - DNA, 28 bp, Homo sapiens
agggacttttgggggcagatgtgtttcc

SEQ ID NO: 33998 - DNA, 20 bp, Homo sapiens
gggacttttgggggcagatg

SEQ ID NO: 33999 - DNA, 21 bp, Homo sapiens
gggacttttgggggcagatgt

SEQ ID NO: 34000 - DNA, 22 bp, Homo sapiens
gggacttttgggggcagatgtg

SEQ ID NO: 34001 - DNA, 23 bp, Homo sapiens
gggacttttgggggcagatgtgt

SEQ ID NO: 34002 - DNA, 26 bp, Homo sapiens
gggacttttgggggcagatgtgtttc

SEQ ID NO: 34003 - DNA, 17 bp, Homo sapiens
ctatcataatgccccta

SEQ ID NO: 34004 - DNA, 21 bp, Homo sapiens
ctatcataatgcccctaaaaa

SEQ ID NO: 34005 - DNA, 26 bp, Homo sapiens
ctatcataatgcccctaaaaatcctt

SEQ ID NO: 34006 - DNA, 27 bp, Homo sapiens
tatcataatgcccctaaaaatccttat

SEQ ID NO: 34007 - DNA, 25 bp, Homo sapiens
atcataatgcccctaaaaatcctta

SEQ ID NO: 34008 - DNA, 26 bp, Homo sapiens
atcataatgcccctaaaaatccttat

SEQ ID NO: 34009 - DNA, 25 bp, Homo sapiens
taatgcccctaaaaatccttattgc

SEQ ID NO: 34010 - DNA, 26 bp, Homo sapiens
taatgcccctaaaaatccttattgct

SEQ ID NO: 34011 - DNA, 27 bp, Homo sapiens
taatgcccctaaaaatccttattgctc

SEQ ID NO: 34012 - DNA, 28 bp, Homo sapiens
taatgcccctaaaaatccttattgctct

SEQ ID NO: 34013 - DNA, 24 bp, Homo sapiens
aatgcccctaaaaatccttattgc

SEQ ID NO: 34014 - DNA, 16 bp, Homo sapiens
aaatccttattgctct

SEQ ID NO: 34015 - DNA, 25 bp, Homo sapiens
tggggcggagcttccggaggccccg

SEQ ID NO: 34016 - DNA, 16 bp, Homo sapiens
ttccagacacaaccat

SEQ ID NO: 34017 - DNA, 19 bp, Homo sapiens
agattccagacacaaccat

SEQ ID NO: 34018 - DNA, 22 bp, Homo sapiens
cagagattccagacacaaccat

SEQ ID NO: 34019 - DNA, 24 bp, Homo sapiens
atcagagattccagacacaaccat

SEQ ID NO: 34020 - DNA, 21 bp, Homo sapiens
cagagattccagacacaacca

SEQ ID NO: 34021 - DNA, 25 bp, Homo sapiens
gtatcagagattccagacacaacca

SEQ ID NO: 34022 - DNA, 25 bp, Homo sapiens
cgtatcagagattccagacacaacc

SEQ ID NO: 34023 - DNA, 26 bp, Homo sapiens
tcgtatcagagattccagacacaacc

SEQ ID NO: 34024 - DNA, 25 bp, Homo sapiens
tcgtatcagagattccagacacaac

SEQ ID NO: 34025 - DNA, 19 bp, Homo sapiens
gtatcagagattccagaca

SEQ ID NO: 34026 - DNA, 26 bp, Homo sapiens
ttgacatcgtatcagagattccagac

SEQ ID NO: 34027 - DNA, 20 bp, Homo sapiens
ttgacatcgtatcagagatt

SEQ ID NO: 34028 - DNA, 17 bp, Homo sapiens
ctgaatatggtgtttgt

SEQ ID NO: 34029 - DNA, 26 bp, Homo sapiens
actgggatgtcactgaatatggtgtt

SEQ ID NO: 34030 - DNA, 25 bp, Homo sapiens
actgggatgtcactgaatatggtgt

SEQ ID NO: 34031 - DNA, 22 bp, Homo sapiens
tgggatgtcactgaatatggtg

SEQ ID NO: 34032 - DNA, 24 bp, Homo sapiens
actgggatgtcactgaatatggtg

SEQ ID NO: 34033 - DNA, 28 bp, Homo sapiens
aaggactgggatgtcactgaatatggtg

SEQ ID NO: 34034 - DNA, 22 bp, Homo sapiens
actgggatgtcactgaatatgg

SEQ ID NO: 34035 - DNA, 21 bp, Homo sapiens
actgggatgtcactgaatatg

SEQ ID NO: 34036 - DNA, 20 bp, Homo sapiens
actgggatgtcactgaatat

SEQ ID NO: 34037 - DNA, 18 bp, Homo sapiens
actgggatgtcactgaat

SEQ ID NO: 34038 - DNA, 20 bp, Homo sapiens
aggactgggatgtcactgaa

SEQ ID NO: 34039 - DNA, 18 bp, Homo sapiens
aaggactgggatgtcact

SEQ ID NO: 34040 - DNA, 17 bp, Homo sapiens
caaaggactgggatgtc

SEQ ID NO: 34041 - DNA, 19 bp, Homo sapiens
tcaggctcagtcccctccc

SEQ ID NO: 34042 - DNA, 20 bp, Homo sapiens
tcaggctcagtcccctcccg

SEQ ID NO: 34043 - DNA, 21 bp, Homo sapiens
tcaggctcagtcccctcccga

SEQ ID NO: 34044 - DNA, 23 bp, Homo sapiens
tcaggctcagtcccctcccgata

SEQ ID NO: 34045 - DNA, 24 bp, Homo sapiens
tcaggctcagtcccctcccgataa

SEQ ID NO: 34046 - DNA, 26 bp, Homo sapiens
tcaggctcagtcccctcccgataaac

SEQ ID NO: 34047 - DNA, 27 bp, Homo sapiens
tcaggctcagtcccctcccgataaacc

SEQ ID NO: 34048 - DNA, 19 bp, Homo sapiens
tgtgtacacacgtgccagg

SEQ ID NO: 34049 - DNA, 22 bp, Homo sapiens
tgtgtacacacgtgccaggcgc

SEQ ID NO: 34050 - DNA, 24 bp, Homo sapiens
tgtgtacacacgtgccaggcgctg

SEQ ID NO: 34051 - DNA, 25 bp, Homo sapiens
tgtgtacacacgtgccaggcgctgt

SEQ ID NO: 34052 - DNA, 23 bp, Homo sapiens
gtgtacacacgtgccaggcgctg

SEQ ID NO: 34053 - DNA, 24 bp, Homo sapiens
gtgtacacacgtgccaggcgctgt

SEQ ID NO: 34054 - DNA, 21 bp, Homo sapiens
tgtacacacgtgccaggcgct

SEQ ID NO: 34055 - DNA, 22 bp, Homo sapiens
tgtacacacgtgccaggcgctg

SEQ ID NO: 34056 - DNA, 23 bp, Homo sapiens
tgtacacacgtgccaggcgctgt

SEQ ID NO: 34057 - DNA, 25 bp, Homo sapiens
tgtacacacgtgccaggcgctgtct

SEQ ID NO: 34058 - DNA, 19 bp, Homo sapiens
acacacgtgccaggcgctg

SEQ ID NO: 34059 - DNA, 18 bp, Homo sapiens
tgcacggcactggggaca

SEQ ID NO: 34060 - DNA, 19 bp, Homo sapiens
tgcacggcactggggacac

SEQ ID NO: 34061 - DNA, 20 bp, Homo sapiens
tgcacggcactggggacacg

SEQ ID NO: 34062 - DNA, 22 bp, Homo sapiens
tgcacggcactggggacacgtg

SEQ ID NO: 34063 - DNA, 23 bp, Homo sapiens
tgcacggcactggggacacgtgg

SEQ ID NO: 34064 - DNA, 21 bp, Homo sapiens
gcacggcactggggacacgtg

SEQ ID NO: 34065 - DNA, 25 bp, Homo sapiens
tgagcccctgtgccgcccccagttc

SEQ ID NO: 34066 - DNA, 19 bp, Homo sapiens
ccctgtgccgcccccagtt

SEQ ID NO: 34067 - DNA, 23 bp, Homo sapiens
gagcccctgtgccgcccccagtt

SEQ ID NO: 34068 - DNA, 26 bp, Homo sapiens
actgagcccctgtgccgcccccagtt

SEQ ID NO: 34069 - DNA, 18 bp, Homo sapiens
ccctgtgccgcccccagt

SEQ ID NO: 34070 - DNA, 19 bp, Homo sapiens
cccctgtgccgcccccagt

SEQ ID NO: 34071 - DNA, 21 bp, Homo sapiens
agcccctgtgccgcccccagt

SEQ ID NO: 34072 - DNA, 22 bp, Homo sapiens
gagcccctgtgccgcccccagt

SEQ ID NO: 34073 - DNA, 24 bp, Homo sapiens
ctgagcccctgtgccgcccccagt

SEQ ID NO: 34074 - DNA, 25 bp, Homo sapiens
actgagcccctgtgccgcccccagt

SEQ ID NO: 34075 - DNA, 26 bp, Homo sapiens
gactgagcccctgtgccgcccccagt

SEQ ID NO: 34076 - DNA, 27 bp, Homo sapiens
tgactgagcccctgtgccgcccccagt

SEQ ID NO: 34077 - DNA, 28 bp, Homo sapiens
ctgactgagcccctgtgccgcccccagt

SEQ ID NO: 34078 - DNA, 23 bp, Homo sapiens
actgactgagcccctgtgccgcc

SEQ ID NO: 34079 - DNA, 20 bp, Homo sapiens
ctgactgagcccctgtgccg

SEQ ID NO: 34080 - DNA, 21 bp, Homo sapiens
actgactgagcccctgtgccg

SEQ ID NO: 34081 - DNA, 18 bp, Homo sapiens
actgactgagcccctgtg

SEQ ID NO: 34082 - DNA, 17 bp, Homo sapiens
actgactgagcccctgt

SEQ ID NO: 34083 - DNA, 16 bp, Homo sapiens
actgactgagcccctg

SEQ ID NO: 34084 - DNA, 20 bp, Homo sapiens
ggcccagtgggggggagagg

SEQ ID NO: 34085 - DNA, 28 bp, Homo sapiens
gtgggtacggcccagtgggggggagagg

SEQ ID NO: 34086 - DNA, 27 bp, Homo sapiens
gtgggtacggcccagtgggggggagag

SEQ ID NO: 34087 - DNA, 19 bp, Homo sapiens
cggcccagtgggggggaga

SEQ ID NO: 34088 - DNA, 26 bp, Homo sapiens
gtgggtacggcccagtgggggggaga

SEQ ID NO: 34089 - DNA, 25 bp, Homo sapiens
gtgggtacggcccagtgggggggag

SEQ ID NO: 34090 - DNA, 24 bp, Homo sapiens
gtgggtacggcccagtggggggga

SEQ ID NO: 34091 - DNA, 23 bp, Homo sapiens
gtgggtacggcccagtggggggg

SEQ ID NO: 34092 - DNA, 21 bp, Homo sapiens
gtgggtacggcccagtggggg

SEQ ID NO: 34093 - DNA, 19 bp, Homo sapiens
gtgggtacggcccagtggg

SEQ ID NO: 34094 - DNA, 18 bp, Homo sapiens
gtgggtacggcccagtgg

SEQ ID NO: 34095 - DNA, 16 bp, Homo sapiens
gtgggtacggcccagt

SEQ ID NO: 34096 - DNA, 20 bp, Homo sapiens
ggagggagaagggtcggggc

SEQ ID NO: 34097 - DNA, 21 bp, Homo sapiens
ggagggagaagggtcggggca

SEQ ID NO: 34098 - DNA, 22 bp, Homo sapiens
ggagggagaagggtcggggcag

SEQ ID NO: 34099 - DNA, 19 bp, Homo sapiens
gagggagaagggtcggggc

SEQ ID NO: 34100 - DNA, 20 bp, Homo sapiens
gagggagaagggtcggggca

SEQ ID NO: 34101 - DNA, 24 bp, Homo sapiens
gagggagaagggtcggggcaggga

SEQ ID NO: 34102 - DNA, 18 bp, Homo sapiens
gggagaagggtcggggca

SEQ ID NO: 34103 - DNA, 19 bp, Homo sapiens
gggagaagggtcggggcag

SEQ ID NO: 34104 - DNA, 16 bp, Homo sapiens
ggagaagggtcggggc

SEQ ID NO: 34105 - DNA, 17 bp, Homo sapiens
ggagaagggtcggggca

SEQ ID NO: 34106 - DNA, 18 bp, Homo sapiens
ggagaagggtcggggcag

SEQ ID NO: 34107 - DNA, 19 bp, Homo sapiens
ggagaagggtcggggcagg

SEQ ID NO: 34108 - DNA, 19 bp, Homo sapiens
cagtggccagagccctgca

SEQ ID NO: 34109 - DNA, 20 bp, Homo sapiens
cagtggccagagccctgcag

SEQ ID NO: 34110 - DNA, 21 bp, Homo sapiens
cagtggccagagccctgcagt

SEQ ID NO: 34111 - DNA, 23 bp, Homo sapiens
cagtggccagagccctgcagtgc

SEQ ID NO: 34112 - DNA, 24 bp, Homo sapiens
cagtggccagagccctgcagtgct

SEQ ID NO: 34113 - DNA, 26 bp, Homo sapiens
cagtggccagagccctgcagtgctgg

SEQ ID NO: 34114 - DNA, 22 bp, Homo sapiens
agtggccagagccctgcagtgc

SEQ ID NO: 34115 - DNA, 25 bp, Homo sapiens
gggcttctcgtgggctctggccacg

SEQ ID NO: 34116 - DNA, 26 bp, Homo sapiens
gggcttctcgtgggctctggccacgg

SEQ ID NO: 34117 - DNA, 27 bp, Homo sapiens
gggcttctcgtgggctctggccacggc

SEQ ID NO: 34118 - DNA, 17 bp, Homo sapiens
ggaaggaaggcagggcc

SEQ ID NO: 34119 - DNA, 21 bp, Homo sapiens
aggaaggcagggcccccgctc

SEQ ID NO: 34120 - DNA, 20 bp, Homo sapiens
ggaaggcagggcccccgctc

SEQ ID NO: 34121 - DNA, 17 bp, Homo sapiens
aaggcagggcccccgct

SEQ ID NO: 34122 - DNA, 18 bp, Homo sapiens
aaggcagggcccccgctc

SEQ ID NO: 34123 - DNA, 19 bp, Homo sapiens
aaggcagggcccccgctcc

SEQ ID NO: 34124 - DNA, 20 bp, Homo sapiens
aaggcagggcccccgctccc

SEQ ID NO: 34125 - DNA, 22 bp, Homo sapiens
aaggcagggcccccgctccccg

SEQ ID NO: 34126 - DNA, 23 bp, Homo sapiens
aaggcagggcccccgctccccgg

SEQ ID NO: 34127 - DNA, 24 bp, Homo sapiens
aaggcagggcccccgctccccggg

SEQ ID NO: 34128 - DNA, 25 bp, Homo sapiens
aaggcagggcccccgctccccgggc

SEQ ID NO: 34129 - DNA, 22 bp, Homo sapiens
gccacagccacccatgtgtagg

SEQ ID NO: 34130 - DNA, 23 bp, Homo sapiens
gccacagccacccatgtgtaggg

SEQ ID NO: 34131 - DNA, 23 bp, Homo sapiens
gctacacatgggtggctgtggcc

SEQ ID NO: 34132 - DNA, 24 bp, Homo sapiens
ctgggaggtcaaggctgcagtgtc

SEQ ID NO: 34133 - DNA, 23 bp, Homo sapiens
tgggaggtcaaggctgcagtgtc

SEQ ID NO: 34134 - DNA, 23 bp, Homo sapiens
gctgcagactcgacctcccaggc

SEQ ID NO: 34135 - DNA, 24 bp, Homo sapiens
ctgcagactcgacctcccaggctt

SEQ ID NO: 34136 - DNA, 25 bp, Homo sapiens
ctgcagactcgacctcccaggctta

SEQ ID NO: 34137 - DNA, 26 bp, Homo sapiens
ctgcagactcgacctcccaggcttaa

SEQ ID NO: 34138 - DNA, 27 bp, Homo sapiens
ctgcagactcgacctcccaggcttaag

SEQ ID NO: 34139 - DNA, 23 bp, Homo sapiens
tgcagactcgacctcccaggctt

SEQ ID NO: 34140 - DNA, 24 bp, Homo sapiens
tgcagactcgacctcccaggctta

SEQ ID NO: 34141 - DNA, 25 bp, Homo sapiens
tgcagactcgacctcccaggcttaa

SEQ ID NO: 34142 - DNA, 21 bp, Homo sapiens
cagactcgacctcccaggctt

SEQ ID NO: 34143 - DNA, 23 bp, Homo sapiens
cagactcgacctcccaggcttaa

SEQ ID NO: 34144 - DNA, 22 bp, Homo sapiens
atcgcagacagggacacatgga

SEQ ID NO: 34145 - DNA, 23 bp, Homo sapiens
atcgcagacagggacacatggag

SEQ ID NO: 34146 - DNA, 24 bp, Homo sapiens
atcgcagacagggacacatggaga

SEQ ID NO: 34147 - DNA, 21 bp, Homo sapiens
tcgcagacagggacacatgga

SEQ ID NO: 34148 - DNA, 22 bp, Homo sapiens
tcgcagacagggacacatggag

SEQ ID NO: 34149 - DNA, 24 bp, Homo sapiens
tcgcagacagggacacatggagaa

SEQ ID NO: 34150 - DNA, 25 bp, Homo sapiens
tcgcagacagggacacatggagaac

SEQ ID NO: 34151 - DNA, 17 bp, Homo sapiens
cgcagacagggacacat

SEQ ID NO: 34152 - DNA, 21 bp, Homo sapiens
cgcagacagggacacatggag

SEQ ID NO: 34153 - DNA, 22 bp, Homo sapiens
cgcagacagggacacatggaga

SEQ ID NO: 34154 - DNA, 23 bp, Homo sapiens
cgcagacagggacacatggagaa

SEQ ID NO: 34155 - DNA, 24 bp, Homo sapiens
cgcagacagggacacatggagaac

SEQ ID NO: 34156 - DNA, 21 bp, Homo sapiens
tcccacgtgcttctctttccg

SEQ ID NO: 34157 - DNA, 22 bp, Homo sapiens
tcccacgtgcttctctttccgc

SEQ ID NO: 34158 - DNA, 23 bp, Homo sapiens
tcccacgtgcttctctttccgca

SEQ ID NO: 34159 - DNA, 24 bp, Homo sapiens
tcccacgtgcttctctttccgcag

SEQ ID NO: 34160 - DNA, 25 bp, Homo sapiens
tcccacgtgcttctctttccgcagg

SEQ ID NO: 34161 - DNA, 20 bp, Homo sapiens
ccacgtgcttctctttccgc

SEQ ID NO: 34162 - DNA, 23 bp, Homo sapiens
ccacgtgcttctctttccgcagg

SEQ ID NO: 34163 - DNA, 20 bp, Homo sapiens
cacacaggaaaagcggggcc

SEQ ID NO: 34164 - DNA, 21 bp, Homo sapiens
cacacaggaaaagcggggccc

SEQ ID NO: 34165 - DNA, 24 bp, Homo sapiens
cacacaggaaaagcggggccctgg

SEQ ID NO: 34166 - DNA, 25 bp, Homo sapiens
cacacaggaaaagcggggccctggg

SEQ ID NO: 34167 - DNA, 26 bp, Homo sapiens
cacacaggaaaagcggggccctgggt

SEQ ID NO: 34168 - DNA, 18 bp, Homo sapiens
acacaggaaaagcggggc

SEQ ID NO: 34169 - DNA, 22 bp, Homo sapiens
acacaggaaaagcggggccctg

SEQ ID NO: 34170 - DNA, 24 bp, Homo sapiens
acacaggaaaagcggggccctggg

SEQ ID NO: 34171 - DNA, 26 bp, Homo sapiens
acacaggaaaagcggggccctgggtt

SEQ ID NO: 34172 - DNA, 20 bp, Homo sapiens
caaaggccacattctcctgt

SEQ ID NO: 34173 - DNA, 21 bp, Homo sapiens
caaaggccacattctcctgtg

SEQ ID NO: 34174 - DNA, 23 bp, Homo sapiens
caaaggccacattctcctgtgca

SEQ ID NO: 34175 - DNA, 23 bp, Homo sapiens
aaggccacattctcctgtgcaca

SEQ ID NO: 34176 - DNA, 19 bp, Homo sapiens
aggccacattctcctgtgc

SEQ ID NO: 34177 - DNA, 20 bp, Homo sapiens
aggccacattctcctgtgca

SEQ ID NO: 34178 - DNA, 21 bp, Homo sapiens
aggccacattctcctgtgcac

SEQ ID NO: 34179 - DNA, 22 bp, Homo sapiens
aggccacattctcctgtgcaca

SEQ ID NO: 34180 - DNA, 23 bp, Homo sapiens
aggccacattctcctgtgcacac

SEQ ID NO: 34181 - DNA, 24 bp, Homo sapiens
aggccacattctcctgtgcacaca

SEQ ID NO: 34182 - DNA, 24 bp, Homo sapiens
tggaacatagtagggactcaataa

SEQ ID NO: 34183 - DNA, 21 bp, Homo sapiens
aacatagtagggactcaataa

SEQ ID NO: 34184 - DNA, 17 bp, Homo sapiens
cggccggatcggtcgag

SEQ ID NO: 34185 - DNA, 18 bp, Homo sapiens
gcggccggatcggtcgag

SEQ ID NO: 34186 - DNA, 20 bp, Homo sapiens
cggggcgcggccggatcggt

SEQ ID NO: 34187 - DNA, 19 bp, Homo sapiens
cggggcgcggccggatcgg

SEQ ID NO: 34188 - DNA, 18 bp, Homo sapiens
cggggcgcggccggatcg

SEQ ID NO: 34189 - DNA, 18 bp, Homo sapiens
gcggggcgcggccggatc

SEQ ID NO: 34190 - DNA, 19 bp, Homo sapiens
ggcggggcgcggccggatc

SEQ ID NO: 34191 - DNA, 21 bp, Homo sapiens
tgggcggggcgcggccggatc

SEQ ID NO: 34192 - DNA, 17 bp, Homo sapiens
gcggggcgcggccggat

SEQ ID NO: 34193 - DNA, 21 bp, Homo sapiens
ctgggcggggcgcggccggat

SEQ ID NO: 34194 - DNA, 16 bp, Homo sapiens
ctgggcggggcgcggc

SEQ ID NO: 34195 - DNA, 28 bp, Homo sapiens
ggtgcaaaagtaactgcggtttttgcct

SEQ ID NO: 34196 - DNA, 24 bp, Homo sapiens
aaaagtaactgcggtttttgcctt

SEQ ID NO: 34197 - DNA, 27 bp, Homo sapiens
aaaagtaactgcggtttttgcctttca

SEQ ID NO: 34198 - DNA, 20 bp, Homo sapiens
agtaactgcggtttttgcct

SEQ ID NO: 34199 - DNA, 20 bp, Homo sapiens
aactgcggtttttgcctttc

SEQ ID NO: 34200 - DNA, 16 bp, Homo sapiens
gtgacggtgggcaggg

SEQ ID NO: 34201 - DNA, 24 bp, Homo sapiens
agggctccaggtgacggtgggcag

SEQ ID NO: 34202 - DNA, 26 bp, Homo sapiens
tgagggctccaggtgacggtgggcag

SEQ ID NO: 34203 - DNA, 27 bp, Homo sapiens
gtgagggctccaggtgacggtgggcag

SEQ ID NO: 34204 - DNA, 18 bp, Homo sapiens
gctccaggtgacggtggg

SEQ ID NO: 34205 - DNA, 23 bp, Homo sapiens
tgagggctccaggtgacggtggg

SEQ ID NO: 34206 - DNA, 24 bp, Homo sapiens
gtgagggctccaggtgacggtggg

SEQ ID NO: 34207 - DNA, 23 bp, Homo sapiens
gtgagggctccaggtgacggtgg

SEQ ID NO: 34208 - DNA, 17 bp, Homo sapiens
ggctccaggtgacggtg

SEQ ID NO: 34209 - DNA, 21 bp, Homo sapiens
tgagggctccaggtgacggtg

SEQ ID NO: 34210 - DNA, 20 bp, Homo sapiens
tgagggctccaggtgacggt

SEQ ID NO: 34211 - DNA, 21 bp, Homo sapiens
gtgagggctccaggtgacggt

SEQ ID NO: 34212 - DNA, 20 bp, Homo sapiens
gtgagggctccaggtgacgg

SEQ ID NO: 34213 - DNA, 16 bp, Homo sapiens
ccaggtaaatatgatg

SEQ ID NO: 34214 - DNA, 19 bp, Homo sapiens
taaatatgatgaaactcac

SEQ ID NO: 34215 - DNA, 25 bp, Homo sapiens
taaatatgatgaaactcacagctga

SEQ ID NO: 34216 - DNA, 27 bp, Homo sapiens
taaatatgatgaaactcacagctgagg

SEQ ID NO: 34217 - DNA, 28 bp, Homo sapiens
taaatatgatgaaactcacagctgagga

SEQ ID NO: 34218 - DNA, 19 bp, Homo sapiens
aaatatgatgaaactcaca

SEQ ID NO: 34219 - DNA, 20 bp, Homo sapiens
aaatatgatgaaactcacag

SEQ ID NO: 34220 - DNA, 24 bp, Homo sapiens
aaatatgatgaaactcacagctga

SEQ ID NO: 34221 - DNA, 26 bp, Homo sapiens
aaatatgatgaaactcacagctgagg

SEQ ID NO: 34222 - DNA, 27 bp, Homo sapiens
aaatatgatgaaactcacagctgagga

SEQ ID NO: 34223 - DNA, 28 bp, Homo sapiens
aaatatgatgaaactcacagctgaggag

SEQ ID NO: 34224 - DNA, 28 bp, Homo sapiens
aatatgatgaaactcacagctgaggagc

SEQ ID NO: 34225 - DNA, 18 bp, Homo sapiens
gctcagggatgataactg

SEQ ID NO: 34226 - DNA, 23 bp, Homo sapiens
gctcagggatgataactgtgctg

SEQ ID NO: 34227 - DNA, 25 bp, Homo sapiens
gctcagggatgataactgtgctgag

SEQ ID NO: 34228 - DNA, 27 bp, Homo sapiens
gctcagggatgataactgtgctgagaa

SEQ ID NO: 34229 - DNA, 28 bp, Homo sapiens
gctcagggatgataactgtgctgagaag

SEQ ID NO: 34230 - DNA, 24 bp, Homo sapiens
ctcagggatgataactgtgctgag

SEQ ID NO: 34231 - DNA, 25 bp, Homo sapiens
ctcagggatgataactgtgctgaga

SEQ ID NO: 34232 - DNA, 26 bp, Homo sapiens
ctcagggatgataactgtgctgagaa

SEQ ID NO: 34233 - DNA, 27 bp, Homo sapiens
ctcagggatgataactgtgctgagaag

SEQ ID NO: 34234 - DNA, 28 bp, Homo sapiens
ctcagggatgataactgtgctgagaagc

SEQ ID NO: 34235 - DNA, 17 bp, Homo sapiens
gcgcagggctgcactgt

SEQ ID NO: 34236 - DNA, 19 bp, Homo sapiens
gtgcgcagggctgcactgt

SEQ ID NO: 34237 - DNA, 22 bp, Homo sapiens
gcagtgcgcagggctgcactgt

SEQ ID NO: 34238 - DNA, 26 bp, Homo sapiens
ctcagcagtgcgcagggctgcactgt

SEQ ID NO: 34239 - DNA, 22 bp, Homo sapiens
cagcagtgcgcagggctgcact

SEQ ID NO: 34240 - DNA, 21 bp, Homo sapiens
cagcagtgcgcagggctgcac

SEQ ID NO: 34241 - DNA, 17 bp, Homo sapiens
cagtgcgcagggctgca

SEQ ID NO: 34242 - DNA, 19 bp, Homo sapiens
cagcagtgcgcagggctgc

SEQ ID NO: 34243 - DNA, 19 bp, Homo sapiens
ctcagcagtgcgcagggct

SEQ ID NO: 34244 - DNA, 21 bp, Homo sapiens
acctcagcagtgcgcagggct

SEQ ID NO: 34245 - DNA, 23 bp, Homo sapiens
caacctcagcagtgcgcagggct

SEQ ID NO: 34246 - DNA, 18 bp, Homo sapiens
ctcagcagtgcgcagggc

SEQ ID NO: 34247 - DNA, 20 bp, Homo sapiens
acctcagcagtgcgcagggc

SEQ ID NO: 34248 - DNA, 22 bp, Homo sapiens
caacctcagcagtgcgcagggc

SEQ ID NO: 34249 - DNA, 17 bp, Homo sapiens
ctcagcagtgcgcaggg

SEQ ID NO: 34250 - DNA, 18 bp, Homo sapiens
cctcagcagtgcgcaggg

SEQ ID NO: 34251 - DNA, 19 bp, Homo sapiens
acctcagcagtgcgcaggg

SEQ ID NO: 34252 - DNA, 20 bp, Homo sapiens
aacctcagcagtgcgcaggg

SEQ ID NO: 34253 - DNA, 18 bp, Homo sapiens
caacctcagcagtgcgca

SEQ ID NO: 34254 - DNA, 16 bp, Homo sapiens
gaaggcccggcggaga

SEQ ID NO: 34255 - DNA, 16 bp, Homo sapiens
ccggcggtggcttgtg

SEQ ID NO: 34256 - DNA, 17 bp, Homo sapiens
tccggcggtggcttgtg

SEQ ID NO: 34257 - DNA, 19 bp, Homo sapiens
gagtctccggcggtggctt

SEQ ID NO: 34258 - DNA, 18 bp, Homo sapiens
gagtctccggcggtggct

SEQ ID NO: 34259 - DNA, 21 bp, Homo sapiens
taggccaggtgggtatggagg

SEQ ID NO: 34260 - DNA, 18 bp, Homo sapiens
aggtgggtatggaggagc

SEQ ID NO: 34261 - DNA, 19 bp, Homo sapiens
aggtgggtatggaggagcc

SEQ ID NO: 34262 - DNA, 20 bp, Homo sapiens
aggtgggtatggaggagccc

SEQ ID NO: 34263 - DNA, 22 bp, Homo sapiens
aggtgggtatggaggagccctc

SEQ ID NO: 34264 - DNA, 23 bp, Homo sapiens
aggtgggtatggaggagccctca

SEQ ID NO: 34265 - DNA, 24 bp, Homo sapiens
aggtgggtatggaggagccctcat

SEQ ID NO: 34266 - DNA, 25 bp, Homo sapiens
aggtgggtatggaggagccctcata

SEQ ID NO: 34267 - DNA, 23 bp, Homo sapiens
tgagcccctctctgctctccagg

SEQ ID NO: 34268 - DNA, 19 bp, Homo sapiens
gagcccctctctgctctcc

SEQ ID NO: 34269 - DNA, 22 bp, Homo sapiens
gagcccctctctgctctccagg

SEQ ID NO: 34270 - DNA, 23 bp, Homo sapiens
gagcccctctctgctctccaggt

SEQ ID NO: 34271 - DNA, 24 bp, Homo sapiens
gagcccctctctgctctccaggtg

SEQ ID NO: 34272 - DNA, 16 bp, Homo sapiens
gtcagcaccagcgccc

SEQ ID NO: 34273 - DNA, 17 bp, Homo sapiens
agtcagcaccagcgccc

SEQ ID NO: 34274 - DNA, 20 bp, Homo sapiens
ccactgagtcagcaccagcg

SEQ ID NO: 34275 - DNA, 23 bp, Homo sapiens
ctggccactgagtcagcaccagc

SEQ ID NO: 34276 - DNA, 22 bp, Homo sapiens
ctggccactgagtcagcaccag

SEQ ID NO: 34277 - DNA, 20 bp, Homo sapiens
tggccactgagtcagcacca

SEQ ID NO: 34278 - DNA, 20 bp, Homo sapiens
tggtgcctcgggagggcatg

SEQ ID NO: 34279 - DNA, 18 bp, Homo sapiens
cctcgggagggcatgggc

SEQ ID NO: 34280 - DNA, 22 bp, Homo sapiens
cctcgggagggcatgggccagg

SEQ ID NO: 34281 - DNA, 23 bp, Homo sapiens
cctcgggagggcatgggccaggc

SEQ ID NO: 34282 - DNA, 26 bp, Homo sapiens
cctcgggagggcatgggccaggccac

SEQ ID NO: 34283 - DNA, 21 bp, Homo sapiens
ctcgggagggcatgggccagg

SEQ ID NO: 34284 - DNA, 23 bp, Homo sapiens
ctcgggagggcatgggccaggcc

SEQ ID NO: 34285 - DNA, 24 bp, Homo sapiens
ctcgggagggcatgggccaggcca

SEQ ID NO: 34286 - DNA, 21 bp, Homo sapiens
tcgggagggcatgggccaggc

SEQ ID NO: 34287 - DNA, 22 bp, Homo sapiens
tcgggagggcatgggccaggcc

SEQ ID NO: 34288 - DNA, 23 bp, Homo sapiens
tcgggagggcatgggccaggcca

SEQ ID NO: 34289 - DNA, 20 bp, Homo sapiens
cgggagggcatgggccaggc

SEQ ID NO: 34290 - DNA, 21 bp, Homo sapiens
atgagccaaacccctgtctac

SEQ ID NO: 34291 - DNA, 23 bp, Homo sapiens
agccaaacccctgtctacccgca

SEQ ID NO: 34292 - DNA, 20 bp, Homo sapiens
caaacccctgtctacccgca

SEQ ID NO: 34293 - DNA, 22 bp, Homo sapiens
caaacccctgtctacccgcagc

SEQ ID NO: 34294 - DNA, 23 bp, Homo sapiens
caaacccctgtctacccgcagct

SEQ ID NO: 34295 - DNA, 26 bp, Homo sapiens
ttaacatctggctatctcacgagact

SEQ ID NO: 34296 - DNA, 22 bp, Homo sapiens
taacatctggctatctcacgag

SEQ ID NO: 34297 - DNA, 26 bp, Homo sapiens
atctggctatctcacgagactgtatg

SEQ ID NO: 34298 - DNA, 21 bp, Homo sapiens
tctggctatctcacgagactg

SEQ ID NO: 34299 - DNA, 25 bp, Homo sapiens
tctggctatctcacgagactgtatg

SEQ ID NO: 34300 - DNA, 20 bp, Homo sapiens
tggctatctcacgagactgt

SEQ ID NO: 34301 - DNA, 22 bp, Homo sapiens
tggctatctcacgagactgtat

SEQ ID NO: 34302 - DNA, 23 bp, Homo sapiens
tggctatctcacgagactgtatg

SEQ ID NO: 34303 - DNA, 25 bp, Homo sapiens
tggctatctcacgagactgtatgtc

SEQ ID NO: 34304 - DNA, 16 bp, Homo sapiens
atcgggccctcggcgc

SEQ ID NO: 34305 - DNA, 20 bp, Homo sapiens
atcgggccctcggcgccggc

SEQ ID NO: 34306 - DNA, 21 bp, Homo sapiens
atcgggccctcggcgccggcc

SEQ ID NO: 34307 - DNA, 22 bp, Homo sapiens
atcgggccctcggcgccggccc

SEQ ID NO: 34308 - DNA, 23 bp, Homo sapiens
atcgggccctcggcgccggcccg

SEQ ID NO: 34309 - DNA, 24 bp, Homo sapiens
atcgggccctcggcgccggcccgt

SEQ ID NO: 34310 - DNA, 25 bp, Homo sapiens
atcgggccctcggcgccggcccgtt

SEQ ID NO: 34311 - DNA, 17 bp, Homo sapiens
gggccctcggcgccggc

SEQ ID NO: 34312 - DNA, 21 bp, Homo sapiens
ataaggactagtctgcagtga

SEQ ID NO: 34313 - DNA, 20 bp, Homo sapiens
atttctatcaaataaggact

SEQ ID NO: 34314 - DNA, 25 bp, Homo sapiens
acagtactgtgataactgaaggatg

SEQ ID NO: 34315 - DNA, 26 bp, Homo sapiens
tacagtactgtgataactgaaggatg

SEQ ID NO: 34316 - DNA, 27 bp, Homo sapiens
gtacagtactgtgataactgaaggatg

SEQ ID NO: 34317 - DNA, 25 bp, Homo sapiens
tacagtactgtgataactgaaggat

SEQ ID NO: 34318 - DNA, 26 bp, Homo sapiens
gtacagtactgtgataactgaaggat

SEQ ID NO: 34319 - DNA, 24 bp, Homo sapiens
tacagtactgtgataactgaagga

SEQ ID NO: 34320 - DNA, 25 bp, Homo sapiens
gtacagtactgtgataactgaagga

SEQ ID NO: 34321 - DNA, 23 bp, Homo sapiens
tacagtactgtgataactgaagg

SEQ ID NO: 34322 - DNA, 24 bp, Homo sapiens
gtacagtactgtgataactgaagg

SEQ ID NO: 34323 - DNA, 21 bp, Homo sapiens
acagtactgtgataactgaag

SEQ ID NO: 34324 - DNA, 22 bp, Homo sapiens
tacagtactgtgataactgaag

SEQ ID NO: 34325 - DNA, 22 bp, Homo sapiens
gtacagtactgtgataactgaa

SEQ ID NO: 34326 - DNA, 21 bp, Homo sapiens
gtacagtactgtgataactga

SEQ ID NO: 34327 - DNA, 27 bp, Homo sapiens
tcagttatcacagtgctgatgctgtct

SEQ ID NO: 34328 - DNA, 25 bp, Homo sapiens
cagttatcacagtgctgatgctgtc

SEQ ID NO: 34329 - DNA, 26 bp, Homo sapiens
tcagttatcacagtgctgatgctgtc

SEQ ID NO: 34330 - DNA, 24 bp, Homo sapiens
cagttatcacagtgctgatgctgt

SEQ ID NO: 34331 - DNA, 24 bp, Homo sapiens
tcagttatcacagtgctgatgctg

SEQ ID NO: 34332 - DNA, 23 bp, Homo sapiens
tcagttatcacagtgctgatgct

SEQ ID NO: 34333 - DNA, 21 bp, Homo sapiens
cagttatcacagtgctgatgc

SEQ ID NO: 34334 - DNA, 22 bp, Homo sapiens
tcagttatcacagtgctgatgc

SEQ ID NO: 34335 - DNA, 20 bp, Homo sapiens
cagttatcacagtgctgatg

SEQ ID NO: 34336 - DNA, 21 bp, Homo sapiens
tcagttatcacagtgctgatg

SEQ ID NO: 34337 - DNA, 20 bp, Homo sapiens
tcagttatcacagtgctgat

SEQ ID NO: 34338 - DNA, 20 bp, Homo sapiens
tgtagatacgagcaccagcc

SEQ ID NO: 34339 - DNA, 21 bp, Homo sapiens
tgtagatacgagcaccagcca

SEQ ID NO: 34340 - DNA, 23 bp, Homo sapiens
tgtagatacgagcaccagccacc

SEQ ID NO: 34341 - DNA, 22 bp, Homo sapiens
gtagatacgagcaccagccacc

SEQ ID NO: 34342 - DNA, 23 bp, Homo sapiens
gtagatacgagcaccagccaccc

SEQ ID NO: 34343 - DNA, 21 bp, Homo sapiens
agatacgagcaccagccaccc

SEQ ID NO: 34344 - DNA, 24 bp, Homo sapiens
agctggtgttgtgaatcaggccga

SEQ ID NO: 34345 - DNA, 25 bp, Homo sapiens
agctggtgttgtgaatcaggccgac

SEQ ID NO: 34346 - DNA, 26 bp, Homo sapiens
agctggtgttgtgaatcaggccgacg

SEQ ID NO: 34347 - DNA, 27 bp, Homo sapiens
agctggtgttgtgaatcaggccgacga

SEQ ID NO: 34348 - DNA, 26 bp, Homo sapiens
tacccggctatttcacgacaccaggg

SEQ ID NO: 34349 - DNA, 23 bp, Homo sapiens
cggctatttcacgacaccagggt

SEQ ID NO: 34350 - DNA, 16 bp, Homo sapiens
gctatttcacgacacc

SEQ ID NO: 34351 - DNA, 21 bp, Homo sapiens
gctatttcacgacaccagggt

SEQ ID NO: 34352 - DNA, 23 bp, Homo sapiens
gctatttcacgacaccagggttg

SEQ ID NO: 34353 - DNA, 21 bp, Homo sapiens
ctatttcacgacaccagggtt

SEQ ID NO: 34354 - DNA, 20 bp, Homo sapiens
atagacgtggtgaaggattg

SEQ ID NO: 34355 - DNA, 23 bp, Homo sapiens
atagacgtggtgaaggattgagt

SEQ ID NO: 34356 - DNA, 22 bp, Homo sapiens
cgtggtgaaggattgagtgacc

SEQ ID NO: 34357 - DNA, 26 bp, Homo sapiens
ttgctcctgactctgtgcccacaggt

SEQ ID NO: 34358 - DNA, 25 bp, Homo sapiens
ttgctcctgactctgtgcccacagg

SEQ ID NO: 34359 - DNA, 24 bp, Homo sapiens
ttgctcctgactctgtgcccacag

SEQ ID NO: 34360 - DNA, 22 bp, Homo sapiens
ttgctcctgactctgtgcccac

SEQ ID NO: 34361 - DNA, 23 bp, Homo sapiens
tgtaggctggagctgaggactga

SEQ ID NO: 34362 - DNA, 23 bp, Homo sapiens
tgggtgtaggctggagctgagga

SEQ ID NO: 34363 - DNA, 24 bp, Homo sapiens
ctgggtgtaggctggagctgagga

SEQ ID NO: 34364 - DNA, 23 bp, Homo sapiens
ctgggtgtaggctggagctgagg

SEQ ID NO: 34365 - DNA, 24 bp, Homo sapiens
cctgggtgtaggctggagctgagg

SEQ ID NO: 34366 - DNA, 21 bp, Homo sapiens
tgggtgtaggctggagctgag

SEQ ID NO: 34367 - DNA, 23 bp, Homo sapiens
cctgggtgtaggctggagctgag

SEQ ID NO: 34368 - DNA, 21 bp, Homo sapiens
ctgggtgtaggctggagctga

SEQ ID NO: 34369 - DNA, 22 bp, Homo sapiens
cctgggtgtaggctggagctga

SEQ ID NO: 34370 - DNA, 20 bp, Homo sapiens
caatggtcacctccgggact

SEQ ID NO: 34371 - DNA, 19 bp, Homo sapiens
aatggtcacctccgggact

SEQ ID NO: 34372 - DNA, 21 bp, Homo sapiens
aatggtcacctccgggactca

SEQ ID NO: 34373 - DNA, 19 bp, Homo sapiens
atggtcacctccgggactc

SEQ ID NO: 34374 - DNA, 20 bp, Homo sapiens
atggtcacctccgggactca

SEQ ID NO: 34375 - DNA, 21 bp, Homo sapiens
atggtcacctccgggactcag

SEQ ID NO: 34376 - DNA, 22 bp, Homo sapiens
atggtcacctccgggactcagc

SEQ ID NO: 34377 - DNA, 19 bp, Homo sapiens
tgagccccgggcagtgtga

SEQ ID NO: 34378 - DNA, 22 bp, Homo sapiens
agccccgggcagtgtgatcatc

SEQ ID NO: 34379 - DNA, 23 bp, Homo sapiens
agccccgggcagtgtgatcatcc

SEQ ID NO: 34380 - DNA, 24 bp, Homo sapiens
agccccgggcagtgtgatcatcct

SEQ ID NO: 34381 - DNA, 22 bp, Homo sapiens
gccccgggcagtgtgatcatcc

SEQ ID NO: 34382 - DNA, 23 bp, Homo sapiens
gccccgggcagtgtgatcatcct

SEQ ID NO: 34383 - DNA, 24 bp, Homo sapiens
gccccgggcagtgtgatcatcctg

SEQ ID NO: 34384 - DNA, 25 bp, Homo sapiens
gccccgggcagtgtgatcatcctgg

SEQ ID NO: 34385 - DNA, 21 bp, Homo sapiens
gactggcctgggactaccggg

SEQ ID NO: 34386 - DNA, 18 bp, Homo sapiens
actggcctgggactaccg

SEQ ID NO: 34387 - DNA, 20 bp, Homo sapiens
actggcctgggactaccggg

SEQ ID NO: 34388 - DNA, 21 bp, Homo sapiens
actggcctgggactaccgggg

SEQ ID NO: 34389 - DNA, 22 bp, Homo sapiens
actggcctgggactaccggggg

SEQ ID NO: 34390 - DNA, 23 bp, Homo sapiens
actggcctgggactaccgggggt

SEQ ID NO: 34391 - DNA, 24 bp, Homo sapiens
actggcctgggactaccgggggtg

SEQ ID NO: 34392 - DNA, 25 bp, Homo sapiens
actggcctgggactaccgggggtgg

SEQ ID NO: 34393 - DNA, 26 bp, Homo sapiens
ctggccctctctgcccttccgtcccc

SEQ ID NO: 34394 - DNA, 24 bp, Homo sapiens
ctggccctctctgcccttccgtcc

SEQ ID NO: 34395 - DNA, 22 bp, Homo sapiens
tggccctctctgcccttccgtc

SEQ ID NO: 34396 - DNA, 23 bp, Homo sapiens
ctggccctctctgcccttccgtc

SEQ ID NO: 34397 - DNA, 21 bp, Homo sapiens
ctggccctctctgcccttccg

SEQ ID NO: 34398 - DNA, 20 bp, Homo sapiens
ctggccctctctgcccttcc

SEQ ID NO: 34399 - DNA, 19 bp, Homo sapiens
ctggccctctctgcccttc

SEQ ID NO: 34400 - DNA, 26 bp, Homo sapiens
ggggggcaggaggggctcagggagaa

SEQ ID NO: 34401 - DNA, 24 bp, Homo sapiens
gggggcaggaggggctcagggaga

SEQ ID NO: 34402 - DNA, 25 bp, Homo sapiens
ggggggcaggaggggctcagggaga

SEQ ID NO: 34403 - DNA, 23 bp, Homo sapiens
gggggcaggaggggctcagggag

SEQ ID NO: 34404 - DNA, 24 bp, Homo sapiens
ggggggcaggaggggctcagggag

SEQ ID NO: 34405 - DNA, 25 bp, Homo sapiens
gggggggcaggaggggctcagggag

SEQ ID NO: 34406 - DNA, 22 bp, Homo sapiens
gggggcaggaggggctcaggga

SEQ ID NO: 34407 - DNA, 23 bp, Homo sapiens
ggggggcaggaggggctcaggga

SEQ ID NO: 34408 - DNA, 24 bp, Homo sapiens
gggggggcaggaggggctcaggga

SEQ ID NO: 34409 - DNA, 22 bp, Homo sapiens
ggggggcaggaggggctcaggg

SEQ ID NO: 34410 - DNA, 21 bp, Homo sapiens
ggggggcaggaggggctcagg

SEQ ID NO: 34411 - DNA, 22 bp, Homo sapiens
gggggggcaggaggggctcagg

SEQ ID NO: 34412 - DNA, 21 bp, Homo sapiens
gggggggcaggaggggctcag

SEQ ID NO: 34413 - DNA, 19 bp, Homo sapiens
ggggggcaggaggggctca

SEQ ID NO: 34414 - DNA, 18 bp, Homo sapiens
gggggggcaggaggggct

SEQ ID NO: 34415 - DNA, 23 bp, Homo sapiens
actgtcacttctctgcccatagg

SEQ ID NO: 34416 - DNA, 21 bp, Homo sapiens
actgtcacttctctgcccata

SEQ ID NO: 34417 - DNA, 18 bp, Homo sapiens
actgtcacttctctgccc

SEQ ID NO: 34418 - DNA, 24 bp, Homo sapiens
gtcttcactgtcacttctctgccc

SEQ ID NO: 34419 - DNA, 25 bp, Homo sapiens
ttgggcccaggagtaaacaggatta

SEQ ID NO: 34420 - DNA, 24 bp, Homo sapiens
ttgggcccaggagtaaacaggatt

SEQ ID NO: 34421 - DNA, 22 bp, Homo sapiens
tgggcccaggagtaaacaggat

SEQ ID NO: 34422 - DNA, 22 bp, Homo sapiens
ttgggcccaggagtaaacagga

SEQ ID NO: 34423 - DNA, 21 bp, Homo sapiens
ttgggcccaggagtaaacagg

SEQ ID NO: 34424 - DNA, 22 bp, Homo sapiens
gggctgctgctgttcctgagcc

SEQ ID NO: 34425 - DNA, 22 bp, Homo sapiens
cgggctgctgctgttcctgagc

SEQ ID NO: 34426 - DNA, 24 bp, Homo sapiens
cccgggctgctgctgttcctgagc

SEQ ID NO: 34427 - DNA, 23 bp, Homo sapiens
cccgggctgctgctgttcctgag

SEQ ID NO: 34428 - DNA, 18 bp, Homo sapiens
ggctgctgctgttcctga

SEQ ID NO: 34429 - DNA, 19 bp, Homo sapiens
gggctgctgctgttcctga

SEQ ID NO: 34430 - DNA, 22 bp, Homo sapiens
cccgggctgctgctgttcctga

SEQ ID NO: 34431 - DNA, 23 bp, Homo sapiens
gcccgggctgctgctgttcctga

SEQ ID NO: 34432 - DNA, 25 bp, Homo sapiens
cggcccgggctgctgctgttcctga

SEQ ID NO: 34433 - DNA, 21 bp, Homo sapiens
cccgggctgctgctgttcctg

SEQ ID NO: 34434 - DNA, 24 bp, Homo sapiens
cggcccgggctgctgctgttcctg

SEQ ID NO: 34435 - DNA, 20 bp, Homo sapiens
cccgggctgctgctgttcct

SEQ ID NO: 34436 - DNA, 22 bp, Homo sapiens
cggcccgggctgctgctgttcc

SEQ ID NO: 34437 - DNA, 21 bp, Homo sapiens
cggcccgggctgctgctgttc

SEQ ID NO: 34438 - DNA, 20 bp, Homo sapiens
cggcccgggctgctgctgtt

SEQ ID NO: 34439 - DNA, 17 bp, Homo sapiens
cggcccgggctgctgct

SEQ ID NO: 34440 - DNA, 16 bp, Homo sapiens
cagtggttttacccta

SEQ ID NO: 34441 - DNA, 17 bp, Homo sapiens
cagtggttttaccctat

SEQ ID NO: 34442 - DNA, 19 bp, Homo sapiens
cagtggttttaccctatgg

SEQ ID NO: 34443 - DNA, 20 bp, Homo sapiens
cagtggttttaccctatggt

SEQ ID NO: 34444 - DNA, 21 bp, Homo sapiens
cagtggttttaccctatggta

SEQ ID NO: 34445 - DNA, 23 bp, Homo sapiens
cagtggttttaccctatggtagg

SEQ ID NO: 34446 - DNA, 24 bp, Homo sapiens
cagtggttttaccctatggtaggt

SEQ ID NO: 34447 - DNA, 21 bp, Homo sapiens
agtggttttaccctatggtag

SEQ ID NO: 34448 - DNA, 20 bp, Homo sapiens
taccacagggtagaaccacg

SEQ ID NO: 34449 - DNA, 22 bp, Homo sapiens
taccacagggtagaaccacgga

SEQ ID NO: 34450 - DNA, 23 bp, Homo sapiens
taccacagggtagaaccacggac

SEQ ID NO: 34451 - DNA, 24 bp, Homo sapiens
taccacagggtagaaccacggaca

SEQ ID NO: 34452 - DNA, 27 bp, Homo sapiens
taccacagggtagaaccacggacagga

SEQ ID NO: 34453 - DNA, 17 bp, Homo sapiens
accacagggtagaacca

SEQ ID NO: 34454 - DNA, 18 bp, Homo sapiens
accacagggtagaaccac

SEQ ID NO: 34455 - DNA, 19 bp, Homo sapiens
accacagggtagaaccacg

SEQ ID NO: 34456 - DNA, 20 bp, Homo sapiens
accacagggtagaaccacgg

SEQ ID NO: 34457 - DNA, 21 bp, Homo sapiens
accacagggtagaaccacgga

SEQ ID NO: 34458 - DNA, 22 bp, Homo sapiens
accacagggtagaaccacggac

SEQ ID NO: 34459 - DNA, 23 bp, Homo sapiens
accacagggtagaaccacggaca

SEQ ID NO: 34460 - DNA, 22 bp, Homo sapiens
ccacagggtagaaccacggaca

SEQ ID NO: 34461 - DNA, 21 bp, Homo sapiens
cagacactatacgagtcatat

SEQ ID NO: 34462 - DNA, 22 bp, Homo sapiens
cagacactatacgagtcatata

SEQ ID NO: 34463 - DNA, 21 bp, Homo sapiens
agacactatacgagtcatata

SEQ ID NO: 34464 - DNA, 22 bp, Homo sapiens
agacactatacgagtcatataa

SEQ ID NO: 34465 - DNA, 19 bp, Homo sapiens
gacactatacgagtcatat

SEQ ID NO: 34466 - DNA, 20 bp, Homo sapiens
gacactatacgagtcatata

SEQ ID NO: 34467 - DNA, 21 bp, Homo sapiens
gacactatacgagtcatataa

SEQ ID NO: 34468 - DNA, 20 bp, Homo sapiens
ctatacgagtcatataaggg

SEQ ID NO: 34469 - DNA, 21 bp, Homo sapiens
ctatacgagtcatataaggga

SEQ ID NO: 34470 - DNA, 19 bp, Homo sapiens
tataggactcatatagtgc

SEQ ID NO: 34471 - DNA, 23 bp, Homo sapiens
tataggactcatatagtgccagg

SEQ ID NO: 34472 - DNA, 17 bp, Homo sapiens
ataggactcatatagtg

SEQ ID NO: 34473 - DNA, 19 bp, Homo sapiens
ataggactcatatagtgcc

SEQ ID NO: 34474 - DNA, 20 bp, Homo sapiens
ataggactcatatagtgcca

SEQ ID NO: 34475 - DNA, 22 bp, Homo sapiens
ataggactcatatagtgccagg

SEQ ID NO: 34476 - DNA, 23 bp, Homo sapiens
ataggactcatatagtgccaggt

SEQ ID NO: 34477 - DNA, 24 bp, Homo sapiens
ataggactcatatagtgccaggtg

SEQ ID NO: 34478 - DNA, 26 bp, Homo sapiens
ataggactcatatagtgccaggtgtt

SEQ ID NO: 34479 - DNA, 27 bp, Homo sapiens
ataggactcatatagtgccaggtgttt

SEQ ID NO: 34480 - DNA, 19 bp, Homo sapiens
taggactcatatagtgcca

SEQ ID NO: 34481 - DNA, 21 bp, Homo sapiens
taggactcatatagtgccagg

SEQ ID NO: 34482 - DNA, 22 bp, Homo sapiens
taggactcatatagtgccaggt

SEQ ID NO: 34483 - DNA, 23 bp, Homo sapiens
taggactcatatagtgccaggtg

SEQ ID NO: 34484 - DNA, 21 bp, Homo sapiens
gactcatatagtgccaggtgt

SEQ ID NO: 34485 - DNA, 23 bp, Homo sapiens
ttcacaaatctataatatgcagg

SEQ ID NO: 34486 - DNA, 20 bp, Homo sapiens
tcacaaatctataatatgca

SEQ ID NO: 34487 - DNA, 21 bp, Homo sapiens
tcacaaatctataatatgcag

SEQ ID NO: 34488 - DNA, 23 bp, Homo sapiens
tcacaaatctataatatgcaggt

SEQ ID NO: 34489 - DNA, 22 bp, Homo sapiens
cacaaatctataatatgcaggt

SEQ ID NO: 34490 - DNA, 19 bp, Homo sapiens
acaaatctataatatgcag

SEQ ID NO: 34491 - DNA, 22 bp, Homo sapiens
caaatctataatatgcaggtca

SEQ ID NO: 34492 - DNA, 21 bp, Homo sapiens
agcctggcatatttggtataa

SEQ ID NO: 34493 - DNA, 23 bp, Homo sapiens
agcctggcatatttggtataact

SEQ ID NO: 34494 - DNA, 22 bp, Homo sapiens
gcctggcatatttggtataact

SEQ ID NO: 34495 - DNA, 21 bp, Homo sapiens
cctggcatatttggtataact

SEQ ID NO: 34496 - DNA, 20 bp, Homo sapiens
ctggcatatttggtataact

SEQ ID NO: 34497 - DNA, 21 bp, Homo sapiens
ctggcatatttggtataactt

SEQ ID NO: 34498 - DNA, 19 bp, Homo sapiens
tggcatatttggtataact

SEQ ID NO: 34499 - DNA, 24 bp, Homo sapiens
tggcatatttggtataacttaagc

SEQ ID NO: 34500 - DNA, 22 bp, Homo sapiens
gcatatttggtataacttaagc

SEQ ID NO: 34501 - DNA, 23 bp, Homo sapiens
catatttggtataacttaagcac

SEQ ID NO: 34502 - DNA, 21 bp, Homo sapiens
tatttggtataacttaagcac

SEQ ID NO: 34503 - DNA, 18 bp, Homo sapiens
ttggtataacttaagcac

SEQ ID NO: 34504 - DNA, 17 bp, Homo sapiens
tggtataacttaagcac

SEQ ID NO: 34505 - DNA, 23 bp, Homo sapiens
tgcttaagttgtaccaagtatag

SEQ ID NO: 34506 - DNA, 23 bp, Homo sapiens
ttaagttgtaccaagtatagcca

SEQ ID NO: 34507 - DNA, 19 bp, Homo sapiens
ttgtaccaagtatagccaa

SEQ ID NO: 34508 - DNA, 17 bp, Homo sapiens
tgaggtgaccgcagatg

SEQ ID NO: 34509 - DNA, 18 bp, Homo sapiens
tgaggtgaccgcagatgg

SEQ ID NO: 34510 - DNA, 19 bp, Homo sapiens
tgaggtgaccgcagatggg

SEQ ID NO: 34511 - DNA, 20 bp, Homo sapiens
tgaggtgaccgcagatggga

SEQ ID NO: 34512 - DNA, 22 bp, Homo sapiens
tgaggtgaccgcagatgggaag

SEQ ID NO: 34513 - DNA, 23 bp, Homo sapiens
tgaggtgaccgcagatgggaagg

SEQ ID NO: 34514 - DNA, 24 bp, Homo sapiens
tgaggtgaccgcagatgggaagga

SEQ ID NO: 34515 - DNA, 25 bp, Homo sapiens
tgaggtgaccgcagatgggaaggaa

SEQ ID NO: 34516 - DNA, 21 bp, Homo sapiens
gtctggctgtgctgtaatgca

SEQ ID NO: 34517 - DNA, 23 bp, Homo sapiens
gtctggctgtgctgtaatgcagt

SEQ ID NO: 34518 - DNA, 24 bp, Homo sapiens
gtctggctgtgctgtaatgcagtc

SEQ ID NO: 34519 - DNA, 18 bp, Homo sapiens
tctggctgtgctgtaatg

SEQ ID NO: 34520 - DNA, 20 bp, Homo sapiens
tctggctgtgctgtaatgca

SEQ ID NO: 34521 - DNA, 22 bp, Homo sapiens
tctggctgtgctgtaatgcagt

SEQ ID NO: 34522 - DNA, 23 bp, Homo sapiens
tctggctgtgctgtaatgcagtc

SEQ ID NO: 34523 - DNA, 21 bp, Homo sapiens
ctggctgtgctgtaatgcagt

SEQ ID NO: 34524 - DNA, 20 bp, Homo sapiens
tggctgtgctgtaatgcagt

SEQ ID NO: 34525 - DNA, 21 bp, Homo sapiens
tggctgtgctgtaatgcagtc

SEQ ID NO: 34526 - DNA, 20 bp, Homo sapiens
tgcattacagcacagccatt

SEQ ID NO: 34527 - DNA, 21 bp, Homo sapiens
tgcattacagcacagccattc

SEQ ID NO: 34528 - DNA, 18 bp, Homo sapiens
cattacagcacagccatt

SEQ ID NO: 34529 - DNA, 23 bp, Homo sapiens
cattacagcacagccattctctc

SEQ ID NO: 34530 - DNA, 16 bp, Homo sapiens
cagccattctctctac

SEQ ID NO: 34531 - DNA, 20 bp, Homo sapiens
tctcccacgttgtggcccag

SEQ ID NO: 34532 - DNA, 21 bp, Homo sapiens
tctcccacgttgtggcccagc

SEQ ID NO: 34533 - DNA, 22 bp, Homo sapiens
tctcccacgttgtggcccagca

SEQ ID NO: 34534 - DNA, 26 bp, Homo sapiens
gcacctggactttgatcttgccataa

SEQ ID NO: 34535 - DNA, 16 bp, Homo sapiens
gcttctgtagtgtagt

SEQ ID NO: 34536 - DNA, 18 bp, Homo sapiens
gcttctgtagtgtagtcc

SEQ ID NO: 34537 - DNA, 19 bp, Homo sapiens
gcttctgtagtgtagtccg

SEQ ID NO: 34538 - DNA, 23 bp, Homo sapiens
gcttctgtagtgtagtccgtgca

SEQ ID NO: 34539 - DNA, 17 bp, Homo sapiens
gtagtgtagtccgtgca

SEQ ID NO: 34540 - DNA, 16 bp, Homo sapiens
tagtgtagtccgtgca

SEQ ID NO: 34541 - DNA, 22 bp, Homo sapiens
tgaggctggctaggagcacagc

SEQ ID NO: 34542 - DNA, 18 bp, Homo sapiens
atgaggctggctaggagc

SEQ ID NO: 34543 - DNA, 22 bp, Homo sapiens
aggaaatgaggctggctaggag

SEQ ID NO: 34544 - DNA, 20 bp, Homo sapiens
aggaaatgaggctggctagg

SEQ ID NO: 34545 - DNA, 21 bp, Homo sapiens
attaggaaatgaggctggcta

SEQ ID NO: 34546 - DNA, 24 bp, Homo sapiens
gaggcagaagcaggatgacaatga

SEQ ID NO: 34547 - DNA, 23 bp, Homo sapiens
gaggcagaagcaggatgacaatg

SEQ ID NO: 34548 - DNA, 22 bp, Homo sapiens
gaggcagaagcaggatgacaat

SEQ ID NO: 34549 - DNA, 21 bp, Homo sapiens
ggaggcagaagcaggatgaca

SEQ ID NO: 34550 - DNA, 22 bp, Homo sapiens
gggaggcagaagcaggatgaca

SEQ ID NO: 34551 - DNA, 22 bp, Homo sapiens
agggaggcagaagcaggatgac

SEQ ID NO: 34552 - DNA, 25 bp, Homo sapiens
ccagtcctgtgcctgccgcctttgt

SEQ ID NO: 34553 - DNA, 24 bp, Homo sapiens
ccagtcctgtgcctgccgcctttg

SEQ ID NO: 34554 - DNA, 23 bp, Homo sapiens
ccagtcctgtgcctgccgccttt

SEQ ID NO: 34555 - DNA, 22 bp, Homo sapiens
ccagtcctgtgcctgccgcctt

SEQ ID NO: 34556 - DNA, 23 bp, Homo sapiens
gccagtcctgtgcctgccgcctt

SEQ ID NO: 34557 - DNA, 20 bp, Homo sapiens
ccagtcctgtgcctgccgcc

SEQ ID NO: 34558 - DNA, 19 bp, Homo sapiens
ccagtcctgtgcctgccgc

SEQ ID NO: 34559 - DNA, 19 bp, Homo sapiens
cagccagtcctgtgcctgc

SEQ ID NO: 34560 - DNA, 20 bp, Homo sapiens
acttgggcaggagggaccct

SEQ ID NO: 34561 - DNA, 21 bp, Homo sapiens
acttgggcaggagggaccctg

SEQ ID NO: 34562 - DNA, 22 bp, Homo sapiens
acttgggcaggagggaccctgt

SEQ ID NO: 34563 - DNA, 23 bp, Homo sapiens
acttgggcaggagggaccctgta

SEQ ID NO: 34564 - DNA, 24 bp, Homo sapiens
acttgggcaggagggaccctgtat

SEQ ID NO: 34565 - DNA, 26 bp, Homo sapiens
acttgggcaggagggaccctgtatgt

SEQ ID NO: 34566 - DNA, 27 bp, Homo sapiens
acttgggcaggagggaccctgtatgtc

SEQ ID NO: 34567 - DNA, 21 bp, Homo sapiens
cttgggcaggagggaccctgt

SEQ ID NO: 34568 - DNA, 22 bp, Homo sapiens
cttgggcaggagggaccctgta

SEQ ID NO: 34569 - DNA, 24 bp, Homo sapiens
cttgggcaggagggaccctgtatg

SEQ ID NO: 34570 - DNA, 22 bp, Homo sapiens
ttgggcaggagggaccctgtat

SEQ ID NO: 34571 - DNA, 24 bp, Homo sapiens
ttgggcaggagggaccctgtatgt

SEQ ID NO: 34572 - DNA, 25 bp, Homo sapiens
ttgggcaggagggaccctgtatgtc

SEQ ID NO: 34573 - DNA, 26 bp, Homo sapiens
ttgggcaggagggaccctgtatgtct

SEQ ID NO: 34574 - DNA, 27 bp, Homo sapiens
ttgggcaggagggaccctgtatgtctc

SEQ ID NO: 34575 - DNA, 20 bp, Homo sapiens
catcgtgtccctcttgtcca

SEQ ID NO: 34576 - DNA, 21 bp, Homo sapiens
catcgtgtccctcttgtccac

SEQ ID NO: 34577 - DNA, 22 bp, Homo sapiens
catcgtgtccctcttgtccaca

SEQ ID NO: 34578 - DNA, 23 bp, Homo sapiens
catcgtgtccctcttgtccacag

SEQ ID NO: 34579 - DNA, 17 bp, Homo sapiens
atcgtgtccctcttgtc

SEQ ID NO: 34580 - DNA, 21 bp, Homo sapiens
atcgtgtccctcttgtccaca

SEQ ID NO: 34581 - DNA, 23 bp, Homo sapiens
atcgtgtccctcttgtccacagc

SEQ ID NO: 34582 - DNA, 19 bp, Homo sapiens
tcgtgtccctcttgtccac

SEQ ID NO: 34583 - DNA, 20 bp, Homo sapiens
tcgtgtccctcttgtccaca

SEQ ID NO: 34584 - DNA, 22 bp, Homo sapiens
tcgtgtccctcttgtccacagc

SEQ ID NO: 34585 - DNA, 23 bp, Homo sapiens
tcgtgtccctcttgtccacagca

SEQ ID NO: 34586 - DNA, 25 bp, Homo sapiens
tgggtgaatttgtagaaggatgaaa

SEQ ID NO: 34587 - DNA, 23 bp, Homo sapiens
tgggtgaatttgtagaaggatga

SEQ ID NO: 34588 - DNA, 24 bp, Homo sapiens
atgggtgaatttgtagaaggatga

SEQ ID NO: 34589 - DNA, 22 bp, Homo sapiens
tgggtgaatttgtagaaggatg

SEQ ID NO: 34590 - DNA, 23 bp, Homo sapiens
atgggtgaatttgtagaaggatg

SEQ ID NO: 34591 - DNA, 24 bp, Homo sapiens
gatgggtgaatttgtagaaggatg

SEQ ID NO: 34592 - DNA, 25 bp, Homo sapiens
tgatgggtgaatttgtagaaggatg

SEQ ID NO: 34593 - DNA, 21 bp, Homo sapiens
tgggtgaatttgtagaaggat

SEQ ID NO: 34594 - DNA, 23 bp, Homo sapiens
gatgggtgaatttgtagaaggat

SEQ ID NO: 34595 - DNA, 24 bp, Homo sapiens
tgatgggtgaatttgtagaaggat

SEQ ID NO: 34596 - DNA, 20 bp, Homo sapiens
tgggtgaatttgtagaagga

SEQ ID NO: 34597 - DNA, 21 bp, Homo sapiens
atgggtgaatttgtagaagga

SEQ ID NO: 34598 - DNA, 22 bp, Homo sapiens
gatgggtgaatttgtagaagga

SEQ ID NO: 34599 - DNA, 23 bp, Homo sapiens
tgatgggtgaatttgtagaagga

SEQ ID NO: 34600 - DNA, 21 bp, Homo sapiens
gatgggtgaatttgtagaagg

SEQ ID NO: 34601 - DNA, 22 bp, Homo sapiens
tgatgggtgaatttgtagaagg

SEQ ID NO: 34602 - DNA, 20 bp, Homo sapiens
tgatgggtgaatttgtagaa

SEQ ID NO: 34603 - DNA, 16 bp, Homo sapiens
tctgccccaggtgaac

SEQ ID NO: 34604 - DNA, 24 bp, Homo sapiens
aggccctgtcctctgccccaggtg

SEQ ID NO: 34605 - DNA, 23 bp, Homo sapiens
aggccctgtcctctgccccaggt

SEQ ID NO: 34606 - DNA, 22 bp, Homo sapiens
aggccctgtcctctgccccagg

SEQ ID NO: 34607 - DNA, 23 bp, Homo sapiens
caggccctgtcctctgccccagg

SEQ ID NO: 34608 - DNA, 22 bp, Homo sapiens
caggccctgtcctctgccccag

SEQ ID NO: 34609 - DNA, 20 bp, Homo sapiens
aggccctgtcctctgcccca

SEQ ID NO: 34610 - DNA, 21 bp, Homo sapiens
ggggagggaggctggacagga

SEQ ID NO: 34611 - DNA, 23 bp, Homo sapiens
tgggggagggaggctggacagga

SEQ ID NO: 34612 - DNA, 26 bp, Homo sapiens
tcggggcatgggggagggaggctgga

SEQ ID NO: 34613 - DNA, 23 bp, Homo sapiens
tcggggcatgggggagggaggct

SEQ ID NO: 34614 - DNA, 22 bp, Homo sapiens
ctcggggcatgggggagggagg

SEQ ID NO: 34615 - DNA, 18 bp, Homo sapiens
tctgggcacaggcggatg

SEQ ID NO: 34616 - DNA, 20 bp, Homo sapiens
tctgggcacaggcggatgga

SEQ ID NO: 34617 - DNA, 21 bp, Homo sapiens
tctgggcacaggcggatggac

SEQ ID NO: 34618 - DNA, 22 bp, Homo sapiens
tctgggcacaggcggatggaca

SEQ ID NO: 34619 - DNA, 23 bp, Homo sapiens
tctgggcacaggcggatggacag

SEQ ID NO: 34620 - DNA, 21 bp, Homo sapiens
tgggcacaggcggatggacag

SEQ ID NO: 34621 - DNA, 22 bp, Homo sapiens
tgggcacaggcggatggacagg

SEQ ID NO: 34622 - DNA, 24 bp, Homo sapiens
tgggcacaggcggatggacaggct

SEQ ID NO: 34623 - DNA, 18 bp, Homo sapiens
tgccaaccgtcagagccc

SEQ ID NO: 34624 - DNA, 20 bp, Homo sapiens
tgccaaccgtcagagcccag

SEQ ID NO: 34625 - DNA, 22 bp, Homo sapiens
tgccaaccgtcagagcccagac

SEQ ID NO: 34626 - DNA, 23 bp, Homo sapiens
tgccaaccgtcagagcccagacc

SEQ ID NO: 34627 - DNA, 24 bp, Homo sapiens
tgccaaccgtcagagcccagaccc

SEQ ID NO: 34628 - DNA, 25 bp, Homo sapiens
gacctgccagcacctccctgcaggg

SEQ ID NO: 34629 - DNA, 23 bp, Homo sapiens
acctgccagcacctccctgcagg

SEQ ID NO: 34630 - DNA, 24 bp, Homo sapiens
gacctgccagcacctccctgcagg

SEQ ID NO: 34631 - DNA, 23 bp, Homo sapiens
gacctgccagcacctccctgcag

SEQ ID NO: 34632 - DNA, 24 bp, Homo sapiens
tgacctgccagcacctccctgcag

SEQ ID NO: 34633 - DNA, 22 bp, Homo sapiens
gacctgccagcacctccctgca

SEQ ID NO: 34634 - DNA, 19 bp, Homo sapiens
ggcctgacctgccagcacc

SEQ ID NO: 34635 - DNA, 22 bp, Homo sapiens
caggagggctgtgccaggttgg

SEQ ID NO: 34636 - DNA, 24 bp, Homo sapiens
ggcaggagggctgtgccaggttgg

SEQ ID NO: 34637 - DNA, 22 bp, Homo sapiens
ggcaggagggctgtgccaggtt

SEQ ID NO: 34638 - DNA, 21 bp, Homo sapiens
ggcaggagggctgtgccaggt

SEQ ID NO: 34639 - DNA, 18 bp, Homo sapiens
gtggtgggcaggagggct

SEQ ID NO: 34640 - DNA, 17 bp, Homo sapiens
gtggtgggcaggagggc

SEQ ID NO: 34641 - DNA, 16 bp, Homo sapiens
gtggtgggcaggaggg

SEQ ID NO: 34642 - DNA, 16 bp, Homo sapiens
tgcggggctagggcta

SEQ ID NO: 34643 - DNA, 17 bp, Homo sapiens
tgcggggctagggctaa

SEQ ID NO: 34644 - DNA, 18 bp, Homo sapiens
tgcggggctagggctaac

SEQ ID NO: 34645 - DNA, 19 bp, Homo sapiens
tgcggggctagggctaaca

SEQ ID NO: 34646 - DNA, 20 bp, Homo sapiens
tgcggggctagggctaacag

SEQ ID NO: 34647 - DNA, 21 bp, Homo sapiens
tgcggggctagggctaacagc

SEQ ID NO: 34648 - DNA, 23 bp, Homo sapiens
tgcggggctagggctaacagcag

SEQ ID NO: 34649 - DNA, 24 bp, Homo sapiens
tgcggggctagggctaacagcagt

SEQ ID NO: 34650 - DNA, 25 bp, Homo sapiens
tgcggggctagggctaacagcagtc

SEQ ID NO: 34651 - DNA, 21 bp, Homo sapiens
gcggggctagggctaacagca

SEQ ID NO: 34652 - DNA, 24 bp, Homo sapiens
gcggggctagggctaacagcagtc

SEQ ID NO: 34653 - DNA, 20 bp, Homo sapiens
cacatgctgttgccactaac

SEQ ID NO: 34654 - DNA, 23 bp, Homo sapiens
cacatgctgttgccactaacctc

SEQ ID NO: 34655 - DNA, 24 bp, Homo sapiens
cacatgctgttgccactaacctca

SEQ ID NO: 34656 - DNA, 26 bp, Homo sapiens
cacatgctgttgccactaacctcaac

SEQ ID NO: 34657 - DNA, 27 bp, Homo sapiens
cacatgctgttgccactaacctcaacc

SEQ ID NO: 34658 - DNA, 20 bp, Homo sapiens
acatgctgttgccactaacc

SEQ ID NO: 34659 - DNA, 23 bp, Homo sapiens
acatgctgttgccactaacctca

SEQ ID NO: 34660 - DNA, 26 bp, Homo sapiens
acatgctgttgccactaacctcaacc

SEQ ID NO: 34661 - DNA, 17 bp, Homo sapiens
ctgttgccactaacctc

SEQ ID NO: 34662 - DNA, 18 bp, Homo sapiens
ctgttgccactaacctca

SEQ ID NO: 34663 - DNA, 19 bp, Homo sapiens
ctgttgccactaacctcaa

SEQ ID NO: 34664 - DNA, 20 bp, Homo sapiens
ctgttgccactaacctcaac

SEQ ID NO: 34665 - DNA, 21 bp, Homo sapiens
ctgttgccactaacctcaacc

SEQ ID NO: 34666 - DNA, 23 bp, Homo sapiens
ctgttgccactaacctcaacctt

SEQ ID NO: 34667 - DNA, 26 bp, Homo sapiens
ctgttgccactaacctcaaccttact

SEQ ID NO: 34668 - DNA, 20 bp, Homo sapiens
tgttgccactaacctcaacc

SEQ ID NO: 34669 - DNA, 18 bp, Homo sapiens
gcccccaacactggcagg

SEQ ID NO: 34670 - DNA, 22 bp, Homo sapiens
caagtggcccccaacactggca

SEQ ID NO: 34671 - DNA, 22 bp, Homo sapiens
cacaagtggcccccaacactgg

SEQ ID NO: 34672 - DNA, 23 bp, Homo sapiens
acacaagtggcccccaacactgg

SEQ ID NO: 34673 - DNA, 24 bp, Homo sapiens
cacacaagtggcccccaacactgg

SEQ ID NO: 34674 - DNA, 22 bp, Homo sapiens
acacaagtggcccccaacactg

SEQ ID NO: 34675 - DNA, 23 bp, Homo sapiens
cacacaagtggcccccaacactg

SEQ ID NO: 34676 - DNA, 21 bp, Homo sapiens
acacaagtggcccccaacact

SEQ ID NO: 34677 - DNA, 21 bp, Homo sapiens
cacacaagtggcccccaacac

SEQ ID NO: 34678 - DNA, 20 bp, Homo sapiens
cacacaagtggcccccaaca

SEQ ID NO: 34679 - DNA, 18 bp, Homo sapiens
cacacaagtggcccccaa

SEQ ID NO: 34680 - DNA, 24 bp, Homo sapiens
tgctgggggccacatgagtgtgca

SEQ ID NO: 34681 - DNA, 23 bp, Homo sapiens
tgctgggggccacatgagtgtgc

SEQ ID NO: 34682 - DNA, 20 bp, Homo sapiens
gctgggggccacatgagtgt

SEQ ID NO: 34683 - DNA, 21 bp, Homo sapiens
tgctgggggccacatgagtgt

SEQ ID NO: 34684 - DNA, 19 bp, Homo sapiens
gctgggggccacatgagtg

SEQ ID NO: 34685 - DNA, 20 bp, Homo sapiens
tgctgggggccacatgagtg

SEQ ID NO: 34686 - DNA, 18 bp, Homo sapiens
gctgggggccacatgagt

SEQ ID NO: 34687 - DNA, 22 bp, Homo sapiens
tgccagtgctgggggccacatg

SEQ ID NO: 34688 - DNA, 24 bp, Homo sapiens
ccaaaggtgaattttttgggaagt

SEQ ID NO: 34689 - DNA, 25 bp, Homo sapiens
cccaaaggtgaattttttgggaagt

SEQ ID NO: 34690 - DNA, 24 bp, Homo sapiens
cccaaaggtgaattttttgggaag

SEQ ID NO: 34691 - DNA, 22 bp, Homo sapiens
ccaaaggtgaattttttgggaa

SEQ ID NO: 34692 - DNA, 23 bp, Homo sapiens
cccaaaggtgaattttttgggaa

SEQ ID NO: 34693 - DNA, 24 bp, Homo sapiens
gcccaaaggtgaattttttgggaa

SEQ ID NO: 34694 - DNA, 21 bp, Homo sapiens
ccaaaggtgaattttttggga

SEQ ID NO: 34695 - DNA, 22 bp, Homo sapiens
cccaaaggtgaattttttggga

SEQ ID NO: 34696 - DNA, 23 bp, Homo sapiens
gcccaaaggtgaattttttggga

SEQ ID NO: 34697 - DNA, 20 bp, Homo sapiens
ccaaaggtgaattttttggg

SEQ ID NO: 34698 - DNA, 21 bp, Homo sapiens
gcccaaaggtgaattttttgg

SEQ ID NO: 34699 - DNA, 19 bp, Homo sapiens
cccaaaggtgaattttttg

SEQ ID NO: 34700 - DNA, 18 bp, Homo sapiens
cccaaaggtgaatttttt

SEQ ID NO: 34701 - DNA, 19 bp, Homo sapiens
gcccaaaggtgaatttttt

SEQ ID NO: 34702 - DNA, 28 bp, Homo sapiens
caaagaattctccttttgggctttctgg

SEQ ID NO: 34703 - DNA, 26 bp, Homo sapiens
aaagaattctccttttgggctttctg

SEQ ID NO: 34704 - DNA, 27 bp, Homo sapiens
caaagaattctccttttgggctttctg

SEQ ID NO: 34705 - DNA, 24 bp, Homo sapiens
aaagaattctccttttgggctttc

SEQ ID NO: 34706 - DNA, 25 bp, Homo sapiens
caaagaattctccttttgggctttc

SEQ ID NO: 34707 - DNA, 24 bp, Homo sapiens
caaagaattctccttttgggcttt

SEQ ID NO: 34708 - DNA, 23 bp, Homo sapiens
caaagaattctccttttgggctt

SEQ ID NO: 34709 - DNA, 23 bp, Homo sapiens
ccaaagaattctccttttgggct

SEQ ID NO: 34710 - DNA, 21 bp, Homo sapiens
caaagaattctccttttgggc

SEQ ID NO: 34711 - DNA, 20 bp, Homo sapiens
caaagaattctccttttggg

SEQ ID NO: 34712 - DNA, 24 bp, Homo sapiens
aagctgccagttgaagaactgttg

SEQ ID NO: 34713 - DNA, 23 bp, Homo sapiens
aagctgccagttgaagaactgtt

SEQ ID NO: 34714 - DNA, 21 bp, Homo sapiens
aagctgccagttgaagaactg

SEQ ID NO: 34715 - DNA, 20 bp, Homo sapiens
aagctgccagttgaagaact

SEQ ID NO: 34716 - DNA, 19 bp, Homo sapiens
aagctgccagttgaagaac

SEQ ID NO: 34717 - DNA, 18 bp, Homo sapiens
aagctgccagttgaagaa

SEQ ID NO: 34718 - DNA, 17 bp, Homo sapiens
aagctgccagttgaaga

SEQ ID NO: 34719 - DNA, 26 bp, Homo sapiens
agttcttcagtggcaagctttatgtc

SEQ ID NO: 34720 - DNA, 24 bp, Homo sapiens
agttcttcagtggcaagctttatg

SEQ ID NO: 34721 - DNA, 23 bp, Homo sapiens
agttcttcagtggcaagctttat

SEQ ID NO: 34722 - DNA, 20 bp, Homo sapiens
gttcttcagtggcaagcttt

SEQ ID NO: 34723 - DNA, 21 bp, Homo sapiens
agttcttcagtggcaagcttt

SEQ ID NO: 34724 - DNA, 20 bp, Homo sapiens
agttcttcagtggcaagctt

SEQ ID NO: 34725 - DNA, 19 bp, Homo sapiens
agttcttcagtggcaagct

SEQ ID NO: 34726 - DNA, 17 bp, Homo sapiens
agttcttcagtggcaag

SEQ ID NO: 34727 - DNA, 25 bp, Homo sapiens
tgatcagcagatcaggactgtaact

SEQ ID NO: 34728 - DNA, 20 bp, Homo sapiens
agcagatcaggactgtaact

SEQ ID NO: 34729 - DNA, 21 bp, Homo sapiens
agcagatcaggactgtaactc

SEQ ID NO: 34730 - DNA, 22 bp, Homo sapiens
agcagatcaggactgtaactca

SEQ ID NO: 34731 - DNA, 23 bp, Homo sapiens
agcagatcaggactgtaactcac

SEQ ID NO: 34732 - DNA, 24 bp, Homo sapiens
agcagatcaggactgtaactcacc

SEQ ID NO: 34733 - DNA, 21 bp, Homo sapiens
gtggactgccctgatctggag

SEQ ID NO: 34734 - DNA, 22 bp, Homo sapiens
gtggactgccctgatctggaga

SEQ ID NO: 34735 - DNA, 23 bp, Homo sapiens
gtggactgccctgatctggagac

SEQ ID NO: 34736 - DNA, 18 bp, Homo sapiens
tggactgccctgatctgg

SEQ ID NO: 34737 - DNA, 20 bp, Homo sapiens
tggactgccctgatctggag

SEQ ID NO: 34738 - DNA, 22 bp, Homo sapiens
tggactgccctgatctggagac

SEQ ID NO: 34739 - DNA, 23 bp, Homo sapiens
tggactgccctgatctggagacc

SEQ ID NO: 34740 - DNA, 24 bp, Homo sapiens
tccactctcctggcccccaggtgt

SEQ ID NO: 34741 - DNA, 23 bp, Homo sapiens
tccactctcctggcccccaggtg

SEQ ID NO: 34742 - DNA, 22 bp, Homo sapiens
tccactctcctggcccccaggt

SEQ ID NO: 34743 - DNA, 20 bp, Homo sapiens
ccactctcctggcccccagg

SEQ ID NO: 34744 - DNA, 21 bp, Homo sapiens
tccactctcctggcccccagg

SEQ ID NO: 34745 - DNA, 22 bp, Homo sapiens
ctccactctcctggcccccagg

SEQ ID NO: 34746 - DNA, 26 bp, Homo sapiens
tgagcctccactctcctggcccccag

SEQ ID NO: 34747 - DNA, 18 bp, Homo sapiens
ccactctcctggccccca

SEQ ID NO: 34748 - DNA, 16 bp, Homo sapiens
cagtggtggagatgga

SEQ ID NO: 34749 - DNA, 26 bp, Homo sapiens
cggggagtcaggcagtggtggagatg

SEQ ID NO: 34750 - DNA, 27 bp, Homo sapiens
acggggagtcaggcagtggtggagatg

SEQ ID NO: 34751 - DNA, 28 bp, Homo sapiens
gacggggagtcaggcagtggtggagatg

SEQ ID NO: 34752 - DNA, 25 bp, Homo sapiens
cggggagtcaggcagtggtggagat

SEQ ID NO: 34753 - DNA, 26 bp, Homo sapiens
acggggagtcaggcagtggtggagat

SEQ ID NO: 34754 - DNA, 24 bp, Homo sapiens
cggggagtcaggcagtggtggaga

SEQ ID NO: 34755 - DNA, 25 bp, Homo sapiens
acggggagtcaggcagtggtggaga

SEQ ID NO: 34756 - DNA, 26 bp, Homo sapiens
gacggggagtcaggcagtggtggaga

SEQ ID NO: 34757 - DNA, 22 bp, Homo sapiens
ggggagtcaggcagtggtggag

SEQ ID NO: 34758 - DNA, 24 bp, Homo sapiens
acggggagtcaggcagtggtggag

SEQ ID NO: 34759 - DNA, 21 bp, Homo sapiens
cggggagtcaggcagtggtgg

SEQ ID NO: 34760 - DNA, 22 bp, Homo sapiens
acggggagtcaggcagtggtgg

SEQ ID NO: 34761 - DNA, 23 bp, Homo sapiens
gacggggagtcaggcagtggtgg

SEQ ID NO: 34762 - DNA, 21 bp, Homo sapiens
acggggagtcaggcagtggtg

SEQ ID NO: 34763 - DNA, 20 bp, Homo sapiens
acggggagtcaggcagtggt

SEQ ID NO: 34764 - DNA, 18 bp, Homo sapiens
cggggagtcaggcagtgg

SEQ ID NO: 34765 - DNA, 19 bp, Homo sapiens
acggggagtcaggcagtgg

SEQ ID NO: 34766 - DNA, 17 bp, Homo sapiens
gacggggagtcaggcag

SEQ ID NO: 34767 - DNA, 25 bp, Homo sapiens
cagtgcctcggcagtgcagcccgga

SEQ ID NO: 34768 - DNA, 24 bp, Homo sapiens
cagtgcctcggcagtgcagcccgg

SEQ ID NO: 34769 - DNA, 23 bp, Homo sapiens
cagtgcctcggcagtgcagcccg

SEQ ID NO: 34770 - DNA, 24 bp, Homo sapiens
tgcagtgcctcggcagtgcagccc

SEQ ID NO: 34771 - DNA, 21 bp, Homo sapiens
cagtgcctcggcagtgcagcc

SEQ ID NO: 34772 - DNA, 22 bp, Homo sapiens
gcagtgcctcggcagtgcagcc

SEQ ID NO: 34773 - DNA, 20 bp, Homo sapiens
cagtgcctcggcagtgcagc

SEQ ID NO: 34774 - DNA, 22 bp, Homo sapiens
tgcagtgcctcggcagtgcagc

SEQ ID NO: 34775 - DNA, 19 bp, Homo sapiens
cagtgcctcggcagtgcag

SEQ ID NO: 34776 - DNA, 18 bp, Homo sapiens
cagtgcctcggcagtgca

SEQ ID NO: 34777 - DNA, 23 bp, Homo sapiens
gtgcattgctgttgcattgcacg

SEQ ID NO: 34778 - DNA, 22 bp, Homo sapiens
gtgcattgctgttgcattgcac

SEQ ID NO: 34779 - DNA, 21 bp, Homo sapiens
gtgcattgctgttgcattgca

SEQ ID NO: 34780 - DNA, 17 bp, Homo sapiens
gcattgctgttgcattg

SEQ ID NO: 34781 - DNA, 18 bp, Homo sapiens
tgcattgctgttgcattg

SEQ ID NO: 34782 - DNA, 19 bp, Homo sapiens
gtgcattgctgttgcattg

SEQ ID NO: 34783 - DNA, 18 bp, Homo sapiens
gtgcattgctgttgcatt

SEQ ID NO: 34784 - DNA, 24 bp, Homo sapiens
gcctccctgacattccacaggtga

SEQ ID NO: 34785 - DNA, 23 bp, Homo sapiens
tgcctccctgacattccacaggt

SEQ ID NO: 34786 - DNA, 24 bp, Homo sapiens
ctgcctccctgacattccacaggt

SEQ ID NO: 34787 - DNA, 22 bp, Homo sapiens
tgcctccctgacattccacagg

SEQ ID NO: 34788 - DNA, 23 bp, Homo sapiens
ctgcctccctgacattccacagg

SEQ ID NO: 34789 - DNA, 19 bp, Homo sapiens
cctccctgacattccacag

SEQ ID NO: 34790 - DNA, 22 bp, Homo sapiens
ctgcctccctgacattccacag

SEQ ID NO: 34791 - DNA, 20 bp, Homo sapiens
tgcctccctgacattccaca

SEQ ID NO: 34792 - DNA, 21 bp, Homo sapiens
ctgcctccctgacattccaca

SEQ ID NO: 34793 - DNA, 19 bp, Homo sapiens
acaggaggcaggtgtggtt

SEQ ID NO: 34794 - DNA, 25 bp, Homo sapiens
agtgggaggacaggaggcaggtgtg

SEQ ID NO: 34795 - DNA, 24 bp, Homo sapiens
agtgggaggacaggaggcaggtgt

SEQ ID NO: 34796 - DNA, 23 bp, Homo sapiens
agtgggaggacaggaggcaggtg

SEQ ID NO: 34797 - DNA, 26 bp, Homo sapiens
ttcaagtgggaggacaggaggcaggt

SEQ ID NO: 34798 - DNA, 21 bp, Homo sapiens
agtgggaggacaggaggcagg

SEQ ID NO: 34799 - DNA, 22 bp, Homo sapiens
aagtgggaggacaggaggcagg

SEQ ID NO: 34800 - DNA, 20 bp, Homo sapiens
agtgggaggacaggaggcag

SEQ ID NO: 34801 - DNA, 21 bp, Homo sapiens
aagtgggaggacaggaggcag

SEQ ID NO: 34802 - DNA, 19 bp, Homo sapiens
agtgggaggacaggaggca

SEQ ID NO: 34803 - DNA, 18 bp, Homo sapiens
agtgggaggacaggaggc

SEQ ID NO: 34804 - DNA, 25 bp, Homo sapiens
tttccggctcgcgtgggtgtgtcgg

SEQ ID NO: 34805 - DNA, 24 bp, Homo sapiens
tttccggctcgcgtgggtgtgtcg

SEQ ID NO: 34806 - DNA, 23 bp, Homo sapiens
tttccggctcgcgtgggtgtgtc

SEQ ID NO: 34807 - DNA, 21 bp, Homo sapiens
tttccggctcgcgtgggtgtg

SEQ ID NO: 34808 - DNA, 20 bp, Homo sapiens
tttccggctcgcgtgggtgt

SEQ ID NO: 34809 - DNA, 19 bp, Homo sapiens
tttccggctcgcgtgggtg

SEQ ID NO: 34810 - DNA, 17 bp, Homo sapiens
tttccggctcgcgtggg

SEQ ID NO: 34811 - DNA, 16 bp, Homo sapiens
tttccggctcgcgtgg

SEQ ID NO: 34812 - DNA, 25 bp, Homo sapiens
ggacccacccggccgggaatagtgc

SEQ ID NO: 34813 - DNA, 23 bp, Homo sapiens
ggacccacccggccgggaatagt

SEQ ID NO: 34814 - DNA, 22 bp, Homo sapiens
ggacccacccggccgggaatag

SEQ ID NO: 34815 - DNA, 20 bp, Homo sapiens
ggacccacccggccgggaat

SEQ ID NO: 34816 - DNA, 19 bp, Homo sapiens
ggacccacccggccgggaa

SEQ ID NO: 34817 - DNA, 18 bp, Homo sapiens
ggacccacccggccggga

SEQ ID NO: 34818 - DNA, 17 bp, Homo sapiens
ggacccacccggccggg

SEQ ID NO: 34819 - DNA, 24 bp, Homo sapiens
taacagtctacagccatggtcgcc

SEQ ID NO: 34820 - DNA, 21 bp, Homo sapiens
acagtctacagccatggtcgc

SEQ ID NO: 34821 - DNA, 22 bp, Homo sapiens
aacagtctacagccatggtcgc

SEQ ID NO: 34822 - DNA, 23 bp, Homo sapiens
taacagtctacagccatggtcgc

SEQ ID NO: 34823 - DNA, 21 bp, Homo sapiens
taacagtctacagccatggtc

SEQ ID NO: 34824 - DNA, 20 bp, Homo sapiens
taacagtctacagccatggt

SEQ ID NO: 34825 - DNA, 19 bp, Homo sapiens
taacagtctacagccatgg

SEQ ID NO: 34826 - DNA, 18 bp, Homo sapiens
taacagtctacagccatg

SEQ ID NO: 34827 - DNA, 17 bp, Homo sapiens
taacagtctacagccat

SEQ ID NO: 34828 - DNA, 16 bp, Homo sapiens
taacagtctacagcca

SEQ ID NO: 34829 - DNA, 24 bp, Homo sapiens
accgtggctttcgattgttactgt

SEQ ID NO: 34830 - DNA, 23 bp, Homo sapiens
accgtggctttcgattgttactg

SEQ ID NO: 34831 - DNA, 23 bp, Homo sapiens
aaccgtggctttcgattgttact

SEQ ID NO: 34832 - DNA, 21 bp, Homo sapiens
accgtggctttcgattgttac

SEQ ID NO: 34833 - DNA, 22 bp, Homo sapiens
aaccgtggctttcgattgttac

SEQ ID NO: 34834 - DNA, 20 bp, Homo sapiens
accgtggctttcgattgtta

SEQ ID NO: 34835 - DNA, 21 bp, Homo sapiens
aaccgtggctttcgattgtta

SEQ ID NO: 34836 - DNA, 19 bp, Homo sapiens
accgtggctttcgattgtt

SEQ ID NO: 34837 - DNA, 20 bp, Homo sapiens
aaccgtggctttcgattgtt

SEQ ID NO: 34838 - DNA, 19 bp, Homo sapiens
aaccgtggctttcgattgt

SEQ ID NO: 34839 - DNA, 16 bp, Homo sapiens
accgtggctttcgatt

SEQ ID NO: 34840 - DNA, 25 bp, Homo sapiens
taacagtctccagtcacggccaccg

SEQ ID NO: 34841 - DNA, 23 bp, Homo sapiens
aacagtctccagtcacggccacc

SEQ ID NO: 34842 - DNA, 24 bp, Homo sapiens
taacagtctccagtcacggccacc

SEQ ID NO: 34843 - DNA, 25 bp, Homo sapiens
gtaacagtctccagtcacggccacc

SEQ ID NO: 34844 - DNA, 23 bp, Homo sapiens
taacagtctccagtcacggccac

SEQ ID NO: 34845 - DNA, 22 bp, Homo sapiens
taacagtctccagtcacggcca

SEQ ID NO: 34846 - DNA, 22 bp, Homo sapiens
gtaacagtctccagtcacggcc

SEQ ID NO: 34847 - DNA, 20 bp, Homo sapiens
taacagtctccagtcacggc

SEQ ID NO: 34848 - DNA, 19 bp, Homo sapiens
taacagtctccagtcacgg

SEQ ID NO: 34849 - DNA, 18 bp, Homo sapiens
taacagtctccagtcacg

SEQ ID NO: 34850 - DNA, 26 bp, Homo sapiens
accttggctctagactgcttactgcc

SEQ ID NO: 34851 - DNA, 24 bp, Homo sapiens
ccttggctctagactgcttactgc

SEQ ID NO: 34852 - DNA, 25 bp, Homo sapiens
accttggctctagactgcttactgc

SEQ ID NO: 34853 - DNA, 24 bp, Homo sapiens
accttggctctagactgcttactg

SEQ ID NO: 34854 - DNA, 22 bp, Homo sapiens
ccttggctctagactgcttact

SEQ ID NO: 34855 - DNA, 21 bp, Homo sapiens
ccttggctctagactgcttac

SEQ ID NO: 34856 - DNA, 22 bp, Homo sapiens
accttggctctagactgcttac

SEQ ID NO: 34857 - DNA, 21 bp, Homo sapiens
accttggctctagactgctta

SEQ ID NO: 34858 - DNA, 20 bp, Homo sapiens
accttggctctagactgctt

SEQ ID NO: 34859 - DNA, 18 bp, Homo sapiens
ccttggctctagactgct

SEQ ID NO: 34860 - DNA, 19 bp, Homo sapiens
accttggctctagactgct

SEQ ID NO: 34861 - DNA, 18 bp, Homo sapiens
accttggctctagactgc

SEQ ID NO: 34862 - DNA, 18 bp, Homo sapiens
ctgtaggccggtggcgtc

SEQ ID NO: 34863 - DNA, 22 bp, Homo sapiens
ctgcctgtaggccggtggcgtc

SEQ ID NO: 34864 - DNA, 24 bp, Homo sapiens
ctctgcctgtaggccggtggcgtc

SEQ ID NO: 34865 - DNA, 25 bp, Homo sapiens
actctgcctgtaggccggtggcgtc

SEQ ID NO: 34866 - DNA, 26 bp, Homo sapiens
gactctgcctgtaggccggtggcgtc

SEQ ID NO: 34867 - DNA, 27 bp, Homo sapiens
tgactctgcctgtaggccggtggcgtc

SEQ ID NO: 34868 - DNA, 20 bp, Homo sapiens
ctgcctgtaggccggtggcg

SEQ ID NO: 34869 - DNA, 19 bp, Homo sapiens
ctgcctgtaggccggtggc

SEQ ID NO: 34870 - DNA, 18 bp, Homo sapiens
ctgcctgtaggccggtgg

SEQ ID NO: 34871 - DNA, 20 bp, Homo sapiens
ctctgcctgtaggccggtgg

SEQ ID NO: 34872 - DNA, 23 bp, Homo sapiens
tgactctgcctgtaggccggtgg

SEQ ID NO: 34873 - DNA, 22 bp, Homo sapiens
tgactctgcctgtaggccggtg

SEQ ID NO: 34874 - DNA, 20 bp, Homo sapiens
gactctgcctgtaggccggt

SEQ ID NO: 34875 - DNA, 20 bp, Homo sapiens
tgactctgcctgtaggccgg

SEQ ID NO: 34876 - DNA, 19 bp, Homo sapiens
tgactctgcctgtaggccg

SEQ ID NO: 34877 - DNA, 18 bp, Homo sapiens
ttccgctgactctgcctg

SEQ ID NO: 34878 - DNA, 26 bp, Homo sapiens
caaccaccactgtctctccccaggcc

SEQ ID NO: 34879 - DNA, 25 bp, Homo sapiens
caaccaccactgtctctccccaggc

SEQ ID NO: 34880 - DNA, 24 bp, Homo sapiens
caaccaccactgtctctccccagg

SEQ ID NO: 34881 - DNA, 22 bp, Homo sapiens
caaccaccactgtctctcccca

SEQ ID NO: 34882 - DNA, 21 bp, Homo sapiens
caaccaccactgtctctcccc

SEQ ID NO: 34883 - DNA, 24 bp, Homo sapiens
tctgggtgcagtgggggttcccac

SEQ ID NO: 34884 - DNA, 21 bp, Homo sapiens
tctgggtgcagtgggggttcc

SEQ ID NO: 34885 - DNA, 22 bp, Homo sapiens
ctctgggtgcagtgggggttcc

SEQ ID NO: 34886 - DNA, 21 bp, Homo sapiens
ctctgggtgcagtgggggttc

SEQ ID NO: 34887 - DNA, 18 bp, Homo sapiens
tctgggtgcagtgggggt

SEQ ID NO: 34888 - DNA, 23 bp, Homo sapiens
agagaagaagatcagcctgcaga

SEQ ID NO: 34889 - DNA, 19 bp, Homo sapiens
ttggtgggggagccatgag

SEQ ID NO: 34890 - DNA, 27 bp, Homo sapiens
ttggtgggggagccatgagataagagc

SEQ ID NO: 34891 - DNA, 26 bp, Homo sapiens
tggtgggggagccatgagataagagc

SEQ ID NO: 34892 - DNA, 19 bp, Homo sapiens
gtgggggagccatgagata

SEQ ID NO: 34893 - DNA, 22 bp, Homo sapiens
gtgggggagccatgagataaga

SEQ ID NO: 34894 - DNA, 23 bp, Homo sapiens
gtgggggagccatgagataagag

SEQ ID NO: 34895 - DNA, 28 bp, Homo sapiens
gtgggggagccatgagataagagcacct

SEQ ID NO: 34896 - DNA, 17 bp, Homo sapiens
tgggggagccatgagat

SEQ ID NO: 34897 - DNA, 21 bp, Homo sapiens
tgggggagccatgagataaga

SEQ ID NO: 34898 - DNA, 22 bp, Homo sapiens
tgggggagccatgagataagag

SEQ ID NO: 34899 - DNA, 23 bp, Homo sapiens
tgggggagccatgagataagagc

SEQ ID NO: 34900 - DNA, 26 bp, Homo sapiens
tgggggagccatgagataagagcacc

SEQ ID NO: 34901 - DNA, 27 bp, Homo sapiens
tgggggagccatgagataagagcacct

SEQ ID NO: 34902 - DNA, 28 bp, Homo sapiens
tgggggagccatgagataagagcacctc

SEQ ID NO: 34903 - DNA, 25 bp, Homo sapiens
gggggagccatgagataagagcacc

SEQ ID NO: 34904 - DNA, 26 bp, Homo sapiens
gggggagccatgagataagagcacct

SEQ ID NO: 34905 - DNA, 21 bp, Homo sapiens
gggagccatgagataagagca

SEQ ID NO: 34906 - DNA, 23 bp, Homo sapiens
gggagccatgagataagagcacc

SEQ ID NO: 34907 - DNA, 24 bp, Homo sapiens
gggagccatgagataagagcacct

SEQ ID NO: 34908 - DNA, 25 bp, Homo sapiens
gggagccatgagataagagcacctc

SEQ ID NO: 34909 - DNA, 26 bp, Homo sapiens
gggagccatgagataagagcacctcc

SEQ ID NO: 34910 - DNA, 24 bp, Homo sapiens
ggagccatgagataagagcacctc

SEQ ID NO: 34911 - DNA, 20 bp, Homo sapiens
gtgccctctctggctcctcc

SEQ ID NO: 34912 - DNA, 23 bp, Homo sapiens
gtgccctctctggctcctcccca

SEQ ID NO: 34913 - DNA, 24 bp, Homo sapiens
gtgccctctctggctcctccccaa

SEQ ID NO: 34914 - DNA, 25 bp, Homo sapiens
gtgccctctctggctcctccccaaa

SEQ ID NO: 34915 - DNA, 19 bp, Homo sapiens
tgccctctctggctcctcc

SEQ ID NO: 34916 - DNA, 21 bp, Homo sapiens
tgccctctctggctcctcccc

SEQ ID NO: 34917 - DNA, 22 bp, Homo sapiens
tgccctctctggctcctcccca

SEQ ID NO: 34918 - DNA, 23 bp, Homo sapiens
tgccctctctggctcctccccaa

SEQ ID NO: 34919 - DNA, 24 bp, Homo sapiens
tgccctctctggctcctccccaaa

SEQ ID NO: 34920 - DNA, 25 bp, Homo sapiens
tgccctctctggctcctccccaaag

SEQ ID NO: 34921 - DNA, 19 bp, Homo sapiens
ccctctctggctcctcccc

SEQ ID NO: 34922 - DNA, 21 bp, Homo sapiens
ccctctctggctcctccccaa

SEQ ID NO: 34923 - DNA, 23 bp, Homo sapiens
ccctctctggctcctccccaaag

SEQ ID NO: 34924 - DNA, 21 bp, Homo sapiens
cctctctggctcctccccaaa

SEQ ID NO: 34925 - DNA, 22 bp, Homo sapiens
cctctctggctcctccccaaag

SEQ ID NO: 34926 - DNA, 23 bp, Homo sapiens
cctctctggctcctccccaaagt

SEQ ID NO: 34927 - DNA, 16 bp, Homo sapiens
tgggtatagcaagaga

SEQ ID NO: 34928 - DNA, 17 bp, Homo sapiens
tgggtatagcaagagaa

SEQ ID NO: 34929 - DNA, 18 bp, Homo sapiens
tgggtatagcaagagaac

SEQ ID NO: 34930 - DNA, 22 bp, Homo sapiens
atagcaagagaaccattaccat

SEQ ID NO: 34931 - DNA, 20 bp, Homo sapiens
tagcaagagaaccattacca

SEQ ID NO: 34932 - DNA, 23 bp, Homo sapiens
agcaagagaaccattaccattac

SEQ ID NO: 34933 - DNA, 21 bp, Homo sapiens
agagaaccattaccattacta

SEQ ID NO: 34934 - DNA, 21 bp, Homo sapiens
agaaccattaccattactaaa

SEQ ID NO: 34935 - DNA, 20 bp, Homo sapiens
gaaccattaccattactaaa

SEQ ID NO: 34936 - DNA, 19 bp, Homo sapiens
aaccattaccattactaaa

SEQ ID NO: 34937 - DNA, 18 bp, Homo sapiens
accattaccattactaaa

SEQ ID NO: 34938 - DNA, 27 bp, Homo sapiens
aaaccgttaccattactgagtttagta

SEQ ID NO: 34939 - DNA, 24 bp, Homo sapiens
aaaccgttaccattactgagttta

SEQ ID NO: 34940 - DNA, 23 bp, Homo sapiens
aaaccgttaccattactgagttt

SEQ ID NO: 34941 - DNA, 21 bp, Homo sapiens
aaaccgttaccattactgagt

SEQ ID NO: 34942 - DNA, 20 bp, Homo sapiens
aaaccgttaccattactgag

SEQ ID NO: 34943 - DNA, 19 bp, Homo sapiens
aaaccgttaccattactga

SEQ ID NO: 34944 - DNA, 24 bp, Homo sapiens
tacagtatagatgatgtactagtc

SEQ ID NO: 34945 - DNA, 22 bp, Homo sapiens
tacagtatagatgatgtactag

SEQ ID NO: 34946 - DNA, 23 bp, Homo sapiens
ctacagtatagatgatgtactag

SEQ ID NO: 34947 - DNA, 21 bp, Homo sapiens
tacagtatagatgatgtacta

SEQ ID NO: 34948 - DNA, 19 bp, Homo sapiens
acagtatagatgatgtact

SEQ ID NO: 34949 - DNA, 21 bp, Homo sapiens
ctacagtatagatgatgtact

SEQ ID NO: 34950 - DNA, 19 bp, Homo sapiens
tacagtatagatgatgtac

SEQ ID NO: 34951 - DNA, 20 bp, Homo sapiens
ctacagtatagatgatgtac

SEQ ID NO: 34952 - DNA, 18 bp, Homo sapiens
tacagtatagatgatgta

SEQ ID NO: 34953 - DNA, 22 bp, Homo sapiens
acactacagtatagatgatgta

SEQ ID NO: 34954 - DNA, 16 bp, Homo sapiens
ctacagtatagatgat

SEQ ID NO: 34955 - DNA, 28 bp, Homo sapiens
ggatatcatcatatactgtaagtttgcg

SEQ ID NO: 34956 - DNA, 26 bp, Homo sapiens
ggatatcatcatatactgtaagtttg

SEQ ID NO: 34957 - DNA, 25 bp, Homo sapiens
ggatatcatcatatactgtaagttt

SEQ ID NO: 34958 - DNA, 23 bp, Homo sapiens
gatatcatcatatactgtaagtt

SEQ ID NO: 34959 - DNA, 24 bp, Homo sapiens
ggatatcatcatatactgtaagtt

SEQ ID NO: 34960 - DNA, 23 bp, Homo sapiens
ggatatcatcatatactgtaagt

SEQ ID NO: 34961 - DNA, 21 bp, Homo sapiens
ggatatcatcatatactgtaa

SEQ ID NO: 34962 - DNA, 20 bp, Homo sapiens
ggatatcatcatatactgta

SEQ ID NO: 34963 - DNA, 19 bp, Homo sapiens
ggatatcatcatatactgt

SEQ ID NO: 34964 - DNA, 21 bp, Homo sapiens
tgggatatcatcatatactgt

SEQ ID NO: 34965 - DNA, 20 bp, Homo sapiens
tgggatatcatcatatactg

SEQ ID NO: 34966 - DNA, 17 bp, Homo sapiens
ggatatcatcatatact

SEQ ID NO: 34967 - DNA, 16 bp, Homo sapiens
ggatatcatcatatac

SEQ ID NO: 34968 - DNA, 18 bp, Homo sapiens
tgtcctgttctgccccca

SEQ ID NO: 34969 - DNA, 23 bp, Homo sapiens
tgacctgtcctgttctgccccca

SEQ ID NO: 34970 - DNA, 22 bp, Homo sapiens
tgacctgtcctgttctgccccc

SEQ ID NO: 34971 - DNA, 26 bp, Homo sapiens
gccctgacctgtcctgttctgccccc

SEQ ID NO: 34972 - DNA, 23 bp, Homo sapiens
cctgacctgtcctgttctgcccc

SEQ ID NO: 34973 - DNA, 25 bp, Homo sapiens
gccctgacctgtcctgttctgcccc

SEQ ID NO: 34974 - DNA, 25 bp, Homo sapiens
tgtagagcagggagcaggaagctgt

SEQ ID NO: 34975 - DNA, 24 bp, Homo sapiens
tgtagagcagggagcaggaagctg

SEQ ID NO: 34976 - DNA, 19 bp, Homo sapiens
gagcagggagcaggaagct

SEQ ID NO: 34977 - DNA, 24 bp, Homo sapiens
ctgtagagcagggagcaggaagct

SEQ ID NO: 34978 - DNA, 20 bp, Homo sapiens
tagagcagggagcaggaagc

SEQ ID NO: 34979 - DNA, 22 bp, Homo sapiens
tgtagagcagggagcaggaagc

SEQ ID NO: 34980 - DNA, 23 bp, Homo sapiens
ctgtagagcagggagcaggaagc

SEQ ID NO: 34981 - DNA, 20 bp, Homo sapiens
gtagagcagggagcaggaag

SEQ ID NO: 34982 - DNA, 21 bp, Homo sapiens
tgtagagcagggagcaggaag

SEQ ID NO: 34983 - DNA, 20 bp, Homo sapiens
tgtagagcagggagcaggaa

SEQ ID NO: 34984 - DNA, 16 bp, Homo sapiens
gggagctgtagagcag

SEQ ID NO: 34985 - DNA, 22 bp, Homo sapiens
ggaccgagagggcctcggctgt

SEQ ID NO: 34986 - DNA, 17 bp, Homo sapiens
gaccgagagggcctcgg

SEQ ID NO: 34987 - DNA, 18 bp, Homo sapiens
gaccgagagggcctcggc

SEQ ID NO: 34988 - DNA, 19 bp, Homo sapiens
gaccgagagggcctcggct

SEQ ID NO: 34989 - DNA, 20 bp, Homo sapiens
gaccgagagggcctcggctg

SEQ ID NO: 34990 - DNA, 22 bp, Homo sapiens
gaccgagagggcctcggctgtg

SEQ ID NO: 34991 - DNA, 23 bp, Homo sapiens
gaccgagagggcctcggctgtgt

SEQ ID NO: 34992 - DNA, 18 bp, Homo sapiens
cgagagggcctcggctgt

SEQ ID NO: 34993 - DNA, 22 bp, Homo sapiens
tctcgctctctgcccctcagcc

SEQ ID NO: 34994 - DNA, 23 bp, Homo sapiens
gtctcgctctctgcccctcagcc

SEQ ID NO: 34995 - DNA, 21 bp, Homo sapiens
tctcgctctctgcccctcagc

SEQ ID NO: 34996 - DNA, 22 bp, Homo sapiens
gtctcgctctctgcccctcagc

SEQ ID NO: 34997 - DNA, 23 bp, Homo sapiens
agtctcgctctctgcccctcagc

SEQ ID NO: 34998 - DNA, 20 bp, Homo sapiens
tctcgctctctgcccctcag

SEQ ID NO: 34999 - DNA, 19 bp, Homo sapiens
tgaggggcagagagcgaga

SEQ ID NO: 35000 - DNA, 21 bp, Homo sapiens
tgaggggcagagagcgagact

SEQ ID NO: 35001 - DNA, 22 bp, Homo sapiens
tgaggggcagagagcgagactt

SEQ ID NO: 35002 - DNA, 24 bp, Homo sapiens
tgaggggcagagagcgagactttt

SEQ ID NO: 35003 - DNA, 25 bp, Homo sapiens
tgaggggcagagagcgagacttttc

SEQ ID NO: 35004 - DNA, 27 bp, Homo sapiens
tgaggggcagagagcgagacttttcta

SEQ ID NO: 35005 - DNA, 28 bp, Homo sapiens
tgaggggcagagagcgagacttttctat

SEQ ID NO: 35006 - DNA, 23 bp, Homo sapiens
tgaggggcctcagaccgagcttt

SEQ ID NO: 35007 - DNA, 21 bp, Homo sapiens
gaggggcctcagaccgagctt

SEQ ID NO: 35008 - DNA, 22 bp, Homo sapiens
tgaggggcctcagaccgagctt

SEQ ID NO: 35009 - DNA, 24 bp, Homo sapiens
aagctcggtctgaggcccctcagt

SEQ ID NO: 35010 - DNA, 25 bp, Homo sapiens
aagctcggtctgaggcccctcagtc

SEQ ID NO: 35011 - DNA, 18 bp, Homo sapiens
agctcggtctgaggcccc

SEQ ID NO: 35012 - DNA, 19 bp, Homo sapiens
agctcggtctgaggcccct

SEQ ID NO: 35013 - DNA, 20 bp, Homo sapiens
agctcggtctgaggcccctc

SEQ ID NO: 35014 - DNA, 21 bp, Homo sapiens
tgaggggcctcagaccgagct

SEQ ID NO: 35015 - DNA, 21 bp, Homo sapiens
agctcggtctgaggcccctca

SEQ ID NO: 35016 - DNA, 22 bp, Homo sapiens
agctcggtctgaggcccctcag

SEQ ID NO: 35017 - DNA, 24 bp, Homo sapiens
agctcggtctgaggcccctcagtc

SEQ ID NO: 35018 - DNA, 25 bp, Homo sapiens
agctcggtctgaggcccctcagtct

SEQ ID NO: 35019 - DNA, 20 bp, Homo sapiens
tgaggggcctcagaccgagc

SEQ ID NO: 35020 - DNA, 19 bp, Homo sapiens
tgaggggcctcagaccgag

SEQ ID NO: 35021 - DNA, 18 bp, Homo sapiens
caagactgaggggcctca

SEQ ID NO: 35022 - DNA, 18 bp, Homo sapiens
tagcattgggatttaagc

SEQ ID NO: 35023 - DNA, 19 bp, Homo sapiens
ctagcattgggatttaagc

SEQ ID NO: 35024 - DNA, 20 bp, Homo sapiens
tctagcattgggatttaagc

SEQ ID NO: 35025 - DNA, 23 bp, Homo sapiens
aggtctagcattgggatttaagc

SEQ ID NO: 35026 - DNA, 22 bp, Homo sapiens
caggtctagcattgggatttaa

SEQ ID NO: 35027 - DNA, 22 bp, Homo sapiens
ccaggtctagcattgggattta

SEQ ID NO: 35028 - DNA, 22 bp, Homo sapiens
caccaggtctagcattgggatt

SEQ ID NO: 35029 - DNA, 23 bp, Homo sapiens
ccaccaggtctagcattgggatt

SEQ ID NO: 35030 - DNA, 21 bp, Homo sapiens
caccaggtctagcattgggat

SEQ ID NO: 35031 - DNA, 19 bp, Homo sapiens
caccaggtctagcattggg

SEQ ID NO: 35032 - DNA, 26 bp, Homo sapiens
tcccaatgctagacccggtggcaatc

SEQ ID NO: 35033 - DNA, 25 bp, Homo sapiens
tcccaatgctagacccggtggcaat

SEQ ID NO: 35034 - DNA, 24 bp, Homo sapiens
tcccaatgctagacccggtggcaa

SEQ ID NO: 35035 - DNA, 23 bp, Homo sapiens
tcccaatgctagacccggtggca

SEQ ID NO: 35036 - DNA, 24 bp, Homo sapiens
atcccaatgctagacccggtggca

SEQ ID NO: 35037 - DNA, 22 bp, Homo sapiens
tcccaatgctagacccggtggc

SEQ ID NO: 35038 - DNA, 23 bp, Homo sapiens
atcccaatgctagacccggtggc

SEQ ID NO: 35039 - DNA, 21 bp, Homo sapiens
tcccaatgctagacccggtgg

SEQ ID NO: 35040 - DNA, 22 bp, Homo sapiens
atcccaatgctagacccggtgg

SEQ ID NO: 35041 - DNA, 23 bp, Homo sapiens
aatcccaatgctagacccggtgg

SEQ ID NO: 35042 - DNA, 24 bp, Homo sapiens
aaatcccaatgctagacccggtgg

SEQ ID NO: 35043 - DNA, 20 bp, Homo sapiens
tcccaatgctagacccggtg

SEQ ID NO: 35044 - DNA, 21 bp, Homo sapiens
atcccaatgctagacccggtg

SEQ ID NO: 35045 - DNA, 23 bp, Homo sapiens
aaatcccaatgctagacccggtg

SEQ ID NO: 35046 - DNA, 20 bp, Homo sapiens
atcccaatgctagacccggt

SEQ ID NO: 35047 - DNA, 21 bp, Homo sapiens
aatcccaatgctagacccggt

SEQ ID NO: 35048 - DNA, 23 bp, Homo sapiens
taaatcccaatgctagacccggt

SEQ ID NO: 35049 - DNA, 24 bp, Homo sapiens
ttaaatcccaatgctagacccggt

SEQ ID NO: 35050 - DNA, 20 bp, Homo sapiens
aatcccaatgctagacccgg

SEQ ID NO: 35051 - DNA, 23 bp, Homo sapiens
ttaaatcccaatgctagacccgg

SEQ ID NO: 35052 - DNA, 23 bp, Homo sapiens
cgcttaaatcccaatgctagacc

SEQ ID NO: 35053 - DNA, 22 bp, Homo sapiens
cgcttaaatcccaatgctagac

SEQ ID NO: 35054 - DNA, 21 bp, Homo sapiens
cgcttaaatcccaatgctaga

SEQ ID NO: 35055 - DNA, 20 bp, Homo sapiens
cgcttaaatcccaatgctag

SEQ ID NO: 35056 - DNA, 24 bp, Homo sapiens
aatgaactgaaccaggagtgagct

SEQ ID NO: 35057 - DNA, 21 bp, Homo sapiens
atgaactgaaccaggagtgag

SEQ ID NO: 35058 - DNA, 22 bp, Homo sapiens
atgaactgaaccaggagtgagc

SEQ ID NO: 35059 - DNA, 19 bp, Homo sapiens
gaactgaaccaggagtgag

SEQ ID NO: 35060 - DNA, 20 bp, Homo sapiens
gaactgaaccaggagtgagc

SEQ ID NO: 35061 - DNA, 21 bp, Homo sapiens
gaactgaaccaggagtgagct

SEQ ID NO: 35062 - DNA, 22 bp, Homo sapiens
gaactgaaccaggagtgagctt

SEQ ID NO: 35063 - DNA, 23 bp, Homo sapiens
gaactgaaccaggagtgagcttc

SEQ ID NO: 35064 - DNA, 28 bp, Homo sapiens
gaactgaaccaggagtgagcttcgtgta

SEQ ID NO: 35065 - DNA, 19 bp, Homo sapiens
aactgaaccaggagtgagc

SEQ ID NO: 35066 - DNA, 20 bp, Homo sapiens
aactgaaccaggagtgagct

SEQ ID NO: 35067 - DNA, 21 bp, Homo sapiens
aactgaaccaggagtgagctt

SEQ ID NO: 35068 - DNA, 22 bp, Homo sapiens
aactgaaccaggagtgagcttc

SEQ ID NO: 35069 - DNA, 24 bp, Homo sapiens
aactgaaccaggagtgagcttcgt

SEQ ID NO: 35070 - DNA, 25 bp, Homo sapiens
aactgaaccaggagtgagcttcgtg

SEQ ID NO: 35071 - DNA, 26 bp, Homo sapiens
aactgaaccaggagtgagcttcgtgt

SEQ ID NO: 35072 - DNA, 22 bp, Homo sapiens
gaaccaggagtgagcttcgtgt

SEQ ID NO: 35073 - DNA, 21 bp, Homo sapiens
aaccaggagtgagcttcgtgt

SEQ ID NO: 35074 - DNA, 24 bp, Homo sapiens
aatgaagtaccttctggttcagct

SEQ ID NO: 35075 - DNA, 27 bp, Homo sapiens
aatgaagtaccttctggttcagctagt

SEQ ID NO: 35076 - DNA, 20 bp, Homo sapiens
aagtaccttctggttcagct

SEQ ID NO: 35077 - DNA, 22 bp, Homo sapiens
aagtaccttctggttcagctag

SEQ ID NO: 35078 - DNA, 23 bp, Homo sapiens
aagtaccttctggttcagctagt

SEQ ID NO: 35079 - DNA, 24 bp, Homo sapiens
aagtaccttctggttcagctagtc

SEQ ID NO: 35080 - DNA, 21 bp, Homo sapiens
agtaccttctggttcagctag

SEQ ID NO: 35081 - DNA, 22 bp, Homo sapiens
agtaccttctggttcagctagt

SEQ ID NO: 35082 - DNA, 23 bp, Homo sapiens
agtaccttctggttcagctagtc

SEQ ID NO: 35083 - DNA, 18 bp, Homo sapiens
accttctggttcagctag

SEQ ID NO: 35084 - DNA, 19 bp, Homo sapiens
accttctggttcagctagt

SEQ ID NO: 35085 - DNA, 20 bp, Homo sapiens
ctggttcagctagtccctgt

SEQ ID NO: 35086 - DNA, 18 bp, Homo sapiens
tgggtctttgcgggcgag

SEQ ID NO: 35087 - DNA, 19 bp, Homo sapiens
tgggtctttgcgggcgaga

SEQ ID NO: 35088 - DNA, 20 bp, Homo sapiens
tgggtctttgcgggcgagat

SEQ ID NO: 35089 - DNA, 21 bp, Homo sapiens
tgggtctttgcgggcgagatg

SEQ ID NO: 35090 - DNA, 23 bp, Homo sapiens
tgggtctttgcgggcgagatgag

SEQ ID NO: 35091 - DNA, 24 bp, Homo sapiens
tgggtctttgcgggcgagatgagg

SEQ ID NO: 35092 - DNA, 21 bp, Homo sapiens
gggtctttgcgggcgagatga

SEQ ID NO: 35093 - DNA, 18 bp, Homo sapiens
aactggcctacaaagtcc

SEQ ID NO: 35094 - DNA, 19 bp, Homo sapiens
aactggcctacaaagtccc

SEQ ID NO: 35095 - DNA, 20 bp, Homo sapiens
aactggcctacaaagtccca

SEQ ID NO: 35096 - DNA, 21 bp, Homo sapiens
aactggcctacaaagtcccag

SEQ ID NO: 35097 - DNA, 23 bp, Homo sapiens
aactggcctacaaagtcccagtt

SEQ ID NO: 35098 - DNA, 24 bp, Homo sapiens
aactggcctacaaagtcccagttc

SEQ ID NO: 35099 - DNA, 26 bp, Homo sapiens
aactggcctacaaagtcccagttctc

SEQ ID NO: 35100 - DNA, 27 bp, Homo sapiens
aactggcctacaaagtcccagttctcg

SEQ ID NO: 35101 - DNA, 19 bp, Homo sapiens
agaccctgcagccttccca

SEQ ID NO: 35102 - DNA, 20 bp, Homo sapiens
agaccctgcagccttcccac

SEQ ID NO: 35103 - DNA, 22 bp, Homo sapiens
agaccctgcagccttcccaccc

SEQ ID NO: 35104 - DNA, 23 bp, Homo sapiens
agaccctgcagccttcccaccca

SEQ ID NO: 35105 - DNA, 24 bp, Homo sapiens
agaccctgcagccttcccacccac

SEQ ID NO: 35106 - DNA, 25 bp, Homo sapiens
agaccctgcagccttcccacccacc

SEQ ID NO: 35107 - DNA, 20 bp, Homo sapiens
tggggaaggcgtcagtgtcg

SEQ ID NO: 35108 - DNA, 21 bp, Homo sapiens
tggggaaggcgtcagtgtcgg

SEQ ID NO: 35109 - DNA, 23 bp, Homo sapiens
tggggaaggcgtcagtgtcgggt

SEQ ID NO: 35110 - DNA, 24 bp, Homo sapiens
tggggaaggcgtcagtgtcgggtg

SEQ ID NO: 35111 - DNA, 25 bp, Homo sapiens
tggggaaggcgtcagtgtcgggtga

SEQ ID NO: 35112 - DNA, 21 bp, Homo sapiens
ggggaaggcgtcagtgtcggg

SEQ ID NO: 35113 - DNA, 16 bp, Homo sapiens
cagtgtcgggtgaggg

SEQ ID NO: 35114 - DNA, 24 bp, Homo sapiens
tgagggactttcaggggcagctgt

SEQ ID NO: 35115 - DNA, 17 bp, Homo sapiens
gagggactttcaggggc

SEQ ID NO: 35116 - DNA, 18 bp, Homo sapiens
gagggactttcaggggca

SEQ ID NO: 35117 - DNA, 20 bp, Homo sapiens
gagggactttcaggggcagc

SEQ ID NO: 35118 - DNA, 23 bp, Homo sapiens
gagggactttcaggggcagctgt

SEQ ID NO: 35119 - DNA, 24 bp, Homo sapiens
gagggactttcaggggcagctgtg

SEQ ID NO: 35120 - DNA, 25 bp, Homo sapiens
gagggactttcaggggcagctgtgt

SEQ ID NO: 35121 - DNA, 17 bp, Homo sapiens
agggactttcaggggca

SEQ ID NO: 35122 - DNA, 18 bp, Homo sapiens
agggactttcaggggcag

SEQ ID NO: 35123 - DNA, 19 bp, Homo sapiens
agggactttcaggggcagc

SEQ ID NO: 35124 - DNA, 20 bp, Homo sapiens
agggactttcaggggcagct

SEQ ID NO: 35125 - DNA, 21 bp, Homo sapiens
agggactttcaggggcagctg

SEQ ID NO: 35126 - DNA, 23 bp, Homo sapiens
agggactttcaggggcagctgtg

SEQ ID NO: 35127 - DNA, 24 bp, Homo sapiens
agggactttcaggggcagctgtgt

SEQ ID NO: 35128 - DNA, 25 bp, Homo sapiens
agggactttcaggggcagctgtgtt

SEQ ID NO: 35129 - DNA, 28 bp, Homo sapiens
agggactttcaggggcagctgtgttttc

SEQ ID NO: 35130 - DNA, 17 bp, Homo sapiens
gggactttcaggggcag

SEQ ID NO: 35131 - DNA, 23 bp, Homo sapiens
gggactttcaggggcagctgtgt

SEQ ID NO: 35132 - DNA, 24 bp, Homo sapiens
cagtcataatgcccctaaaaatcc

SEQ ID NO: 35133 - DNA, 26 bp, Homo sapiens
agtcataatgcccctaaaaatcctta

SEQ ID NO: 35134 - DNA, 27 bp, Homo sapiens
agtcataatgcccctaaaaatccttat

SEQ ID NO: 35135 - DNA, 24 bp, Homo sapiens
gtcataatgcccctaaaaatcctt

SEQ ID NO: 35136 - DNA, 26 bp, Homo sapiens
gtcataatgcccctaaaaatccttat

SEQ ID NO: 35137 - DNA, 25 bp, Homo sapiens
taatgcccctaaaaatccttattgt

SEQ ID NO: 35138 - DNA, 26 bp, Homo sapiens
taatgcccctaaaaatccttattgtt

SEQ ID NO: 35139 - DNA, 27 bp, Homo sapiens
taatgcccctaaaaatccttattgttc

SEQ ID NO: 35140 - DNA, 28 bp, Homo sapiens
taatgcccctaaaaatccttattgttct

SEQ ID NO: 35141 - DNA, 24 bp, Homo sapiens
aatgcccctaaaaatccttattgt

SEQ ID NO: 35142 - DNA, 16 bp, Homo sapiens
cattttgtgtctgctt

SEQ ID NO: 35143 - DNA, 17 bp, Homo sapiens
cattttgtgtctgcttc

SEQ ID NO: 35144 - DNA, 19 bp, Homo sapiens
cattttgtgtctgcttcct

SEQ ID NO: 35145 - DNA, 21 bp, Homo sapiens
cattttgtgtctgcttcctgt

SEQ ID NO: 35146 - DNA, 23 bp, Homo sapiens
cattttgtgtctgcttcctgtgg

SEQ ID NO: 35147 - DNA, 25 bp, Homo sapiens
cattttgtgtctgcttcctgtggga

SEQ ID NO: 35148 - DNA, 28 bp, Homo sapiens
ttttgtgtctgcttcctgtgggacgtgg

SEQ ID NO: 35149 - DNA, 23 bp, Homo sapiens
ttgtgtctgcttcctgtgggacg

SEQ ID NO: 35150 - DNA, 24 bp, Homo sapiens
ttgtgtctgcttcctgtgggacgt

SEQ ID NO: 35151 - DNA, 26 bp, Homo sapiens
ttgtgtctgcttcctgtgggacgtgg

SEQ ID NO: 35152 - DNA, 27 bp, Homo sapiens
ttgtgtctgcttcctgtgggacgtggt

SEQ ID NO: 35153 - DNA, 25 bp, Homo sapiens
tgtgtctgcttcctgtgggacgtgg

SEQ ID NO: 35154 - DNA, 26 bp, Homo sapiens
tgtgtctgcttcctgtgggacgtggt

SEQ ID NO: 35155 - DNA, 18 bp, Homo sapiens
gtgtctgcttcctgtggg

SEQ ID NO: 35156 - DNA, 20 bp, Homo sapiens
gtgtctgcttcctgtgggac

SEQ ID NO: 35157 - DNA, 21 bp, Homo sapiens
gtgtctgcttcctgtgggacg

SEQ ID NO: 35158 - DNA, 23 bp, Homo sapiens
gtgtctgcttcctgtgggacgtg

SEQ ID NO: 35159 - DNA, 22 bp, Homo sapiens
gtctgcttcctgtgggacgtgg

SEQ ID NO: 35160 - DNA, 19 bp, Homo sapiens
ctgcttcctgtgggacgtg

SEQ ID NO: 35161 - DNA, 20 bp, Homo sapiens
ctgcttcctgtgggacgtgg

SEQ ID NO: 35162 - DNA, 21 bp, Homo sapiens
ctgcttcctgtgggacgtggt

SEQ ID NO: 35163 - DNA, 17 bp, Homo sapiens
gcttcctgtgggacgtg

SEQ ID NO: 35164 - DNA, 19 bp, Homo sapiens
gcttcctgtgggacgtggt

SEQ ID NO: 35165 - DNA, 18 bp, Homo sapiens
cttcctgtgggacgtggt

SEQ ID NO: 35166 - DNA, 17 bp, Homo sapiens
ttcctgtgggacgtggt

SEQ ID NO: 35167 - DNA, 16 bp, Homo sapiens
tcctgtgggacgtggt

SEQ ID NO: 35168 - DNA, 23 bp, Homo sapiens
tggatttggagccagaagaactg

SEQ ID NO: 35169 - DNA, 22 bp, Homo sapiens
actggatttggagccagaagaa

SEQ ID NO: 35170 - DNA, 20 bp, Homo sapiens
actggatttggagccagaag

SEQ ID NO: 35171 - DNA, 16 bp, Homo sapiens
aactggatttggagcc

SEQ ID NO: 35172 - DNA, 21 bp, Homo sapiens
ggaggaactggatttggagcc

SEQ ID NO: 35173 - DNA, 24 bp, Homo sapiens
ctgcgggctgcggtcagggcgatc

SEQ ID NO: 35174 - DNA, 25 bp, Homo sapiens
gctgcgggctgcggtcagggcgatc

SEQ ID NO: 35175 - DNA, 23 bp, Homo sapiens
ctgcgggctgcggtcagggcgat

SEQ ID NO: 35176 - DNA, 22 bp, Homo sapiens
ctgcgggctgcggtcagggcga

SEQ ID NO: 35177 - DNA, 23 bp, Homo sapiens
gctgcgggctgcggtcagggcga

SEQ ID NO: 35178 - DNA, 21 bp, Homo sapiens
ctgcgggctgcggtcagggcg

SEQ ID NO: 35179 - DNA, 20 bp, Homo sapiens
ctgcgggctgcggtcagggc

SEQ ID NO: 35180 - DNA, 20 bp, Homo sapiens
gctgcgggctgcggtcaggg

SEQ ID NO: 35181 - DNA, 18 bp, Homo sapiens
ctgcgggctgcggtcagg

SEQ ID NO: 35182 - DNA, 19 bp, Homo sapiens
gctgcgggctgcggtcagg

SEQ ID NO: 35183 - DNA, 16 bp, Homo sapiens
gctgcgggctgcggtc

SEQ ID NO: 35184 - DNA, 18 bp, Homo sapiens
cccggagctgcgggctgc

SEQ ID NO: 35185 - DNA, 21 bp, Homo sapiens
aagggccagaggagcctggag

SEQ ID NO: 35186 - DNA, 22 bp, Homo sapiens
aagggccagaggagcctggagt

SEQ ID NO: 35187 - DNA, 24 bp, Homo sapiens
aagggccagaggagcctggagtgg

SEQ ID NO: 35188 - DNA, 25 bp, Homo sapiens
aagggccagaggagcctggagtggt

SEQ ID NO: 35189 - DNA, 21 bp, Homo sapiens
agggccagaggagcctggagt

SEQ ID NO: 35190 - DNA, 22 bp, Homo sapiens
agggccagaggagcctggagtg

SEQ ID NO: 35191 - DNA, 24 bp, Homo sapiens
agggccagaggagcctggagtggt

SEQ ID NO: 35192 - DNA, 25 bp, Homo sapiens
agggccagaggagcctggagtggtc

SEQ ID NO: 35193 - DNA, 27 bp, Homo sapiens
agggccagaggagcctggagtggtcgg

SEQ ID NO: 35194 - DNA, 23 bp, Homo sapiens
ctgaacccaggttccctctggcc

SEQ ID NO: 35195 - DNA, 19 bp, Homo sapiens
acccaggttccctctggcc

SEQ ID NO: 35196 - DNA, 21 bp, Homo sapiens
acccaggttccctctggccgc

SEQ ID NO: 35197 - DNA, 23 bp, Homo sapiens
acccaggttccctctggccgcag

SEQ ID NO: 35198 - DNA, 24 bp, Homo sapiens
acccaggttccctctggccgcagg

SEQ ID NO: 35199 - DNA, 25 bp, Homo sapiens
acccaggttccctctggccgcaggt

SEQ ID NO: 35200 - DNA, 26 bp, Homo sapiens
acccaggttccctctggccgcaggtc

SEQ ID NO: 35201 - DNA, 21 bp, Homo sapiens
ttaaaatctgccagcttccac

SEQ ID NO: 35202 - DNA, 23 bp, Homo sapiens
aaaatctgccagcttccacagtg

SEQ ID NO: 35203 - DNA, 22 bp, Homo sapiens
aatctgccagcttccacagtgg

SEQ ID NO: 35204 - DNA, 20 bp, Homo sapiens
atctgccagcttccacagtg

SEQ ID NO: 35205 - DNA, 19 bp, Homo sapiens
tctgccagcttccacagtg

SEQ ID NO: 35206 - DNA, 20 bp, Homo sapiens
tctgccagcttccacagtgg

SEQ ID NO: 35207 - DNA, 21 bp, Homo sapiens
tctgccagcttccacagtggc

SEQ ID NO: 35208 - DNA, 19 bp, Homo sapiens
ctgccagcttccacagtgg

SEQ ID NO: 35209 - DNA, 19 bp, Homo sapiens
atagtgggaagctggcaga

SEQ ID NO: 35210 - DNA, 20 bp, Homo sapiens
atagtgggaagctggcagat

SEQ ID NO: 35211 - DNA, 21 bp, Homo sapiens
atagtgggaagctggcagatt

SEQ ID NO: 35212 - DNA, 23 bp, Homo sapiens
atagtgggaagctggcagattcc

SEQ ID NO: 35213 - DNA, 27 bp, Homo sapiens
atagtgggaagctggcagattcctttc

SEQ ID NO: 35214 - DNA, 22 bp, Homo sapiens
tagtgggaagctggcagattcc

SEQ ID NO: 35215 - DNA, 18 bp, Homo sapiens
gctggcagattcctttcc

SEQ ID NO: 35216 - DNA, 16 bp, Homo sapiens
ggagctctgggagggg

SEQ ID NO: 35217 - DNA, 19 bp, Homo sapiens
ctctgggaggggctgggtt

SEQ ID NO: 35218 - DNA, 20 bp, Homo sapiens
ctctgggaggggctgggttt

SEQ ID NO: 35219 - DNA, 22 bp, Homo sapiens
ctctgggaggggctgggtttgg

SEQ ID NO: 35220 - DNA, 22 bp, Homo sapiens
tctgggaggggctgggtttggc

SEQ ID NO: 35221 - DNA, 23 bp, Homo sapiens
tctgggaggggctgggtttggca

SEQ ID NO: 35222 - DNA, 22 bp, Homo sapiens
ctgggaggggctgggtttggca

SEQ ID NO: 35223 - DNA, 24 bp, Homo sapiens
ctgggaggggctgggtttggcagg

SEQ ID NO: 35224 - DNA, 25 bp, Homo sapiens
ctgggaggggctgggtttggcagga

SEQ ID NO: 35225 - DNA, 20 bp, Homo sapiens
tgggaggggctgggtttggc

SEQ ID NO: 35226 - DNA, 21 bp, Homo sapiens
tgggaggggctgggtttggca

SEQ ID NO: 35227 - DNA, 22 bp, Homo sapiens
tgggaggggctgggtttggcag

SEQ ID NO: 35228 - DNA, 23 bp, Homo sapiens
ggaggggctgggtttggcaggac

SEQ ID NO: 35229 - DNA, 20 bp, Homo sapiens
ccaagccctgtctcctccca

SEQ ID NO: 35230 - DNA, 21 bp, Homo sapiens
ccaagccctgtctcctcccat

SEQ ID NO: 35231 - DNA, 22 bp, Homo sapiens
ccaagccctgtctcctcccatc

SEQ ID NO: 35232 - DNA, 23 bp, Homo sapiens
ccaagccctgtctcctcccatct

SEQ ID NO: 35233 - DNA, 20 bp, Homo sapiens
caagccctgtctcctcccat

SEQ ID NO: 35234 - DNA, 21 bp, Homo sapiens
caagccctgtctcctcccatc

SEQ ID NO: 35235 - DNA, 22 bp, Homo sapiens
caagccctgtctcctcccatct

SEQ ID NO: 35236 - DNA, 23 bp, Homo sapiens
caagccctgtctcctcccatctt

SEQ ID NO: 35237 - DNA, 24 bp, Homo sapiens
caagccctgtctcctcccatcttc

SEQ ID NO: 35238 - DNA, 24 bp, Homo sapiens
aagccctgtctcctcccatcttcc

SEQ ID NO: 35239 - DNA, 22 bp, Homo sapiens
agccctgtctcctcccatcttc

SEQ ID NO: 35240 - DNA, 19 bp, Homo sapiens
ccctgtctcctcccatctt

SEQ ID NO: 35241 - DNA, 22 bp, Homo sapiens
ccctgtctcctcccatcttcca

SEQ ID NO: 35242 - DNA, 24 bp, Homo sapiens
ccctgtctcctcccatcttccagt

SEQ ID NO: 35243 - DNA, 23 bp, Homo sapiens
cctgtctcctcccatcttccagt

SEQ ID NO: 35244 - DNA, 24 bp, Homo sapiens
ggggagtgggaggggagaggcagc

SEQ ID NO: 35245 - DNA, 25 bp, Homo sapiens
agtgggaggggagaggcagcaagca

SEQ ID NO: 35246 - DNA, 19 bp, Homo sapiens
gtgggaggggagaggcagc

SEQ ID NO: 35247 - DNA, 23 bp, Homo sapiens
gtgggaggggagaggcagcaagc

SEQ ID NO: 35248 - DNA, 24 bp, Homo sapiens
gtgggaggggagaggcagcaagca

SEQ ID NO: 35249 - DNA, 20 bp, Homo sapiens
tgggaggggagaggcagcaa

SEQ ID NO: 35250 - DNA, 21 bp, Homo sapiens
tgggaggggagaggcagcaag

SEQ ID NO: 35251 - DNA, 22 bp, Homo sapiens
tgggaggggagaggcagcaagc

SEQ ID NO: 35252 - DNA, 24 bp, Homo sapiens
tgggaggggagaggcagcaagcac

SEQ ID NO: 35253 - DNA, 25 bp, Homo sapiens
tgggaggggagaggcagcaagcaca

SEQ ID NO: 35254 - DNA, 19 bp, Homo sapiens
gggaggggagaggcagcaa

SEQ ID NO: 35255 - DNA, 21 bp, Homo sapiens
ggaggggagaggcagcaagca

SEQ ID NO: 35256 - DNA, 19 bp, Homo sapiens
catgctgacctccctcctg

SEQ ID NO: 35257 - DNA, 20 bp, Homo sapiens
catgctgacctccctcctgc

SEQ ID NO: 35258 - DNA, 21 bp, Homo sapiens
catgctgacctccctcctgcc

SEQ ID NO: 35259 - DNA, 22 bp, Homo sapiens
catgctgacctccctcctgccc

SEQ ID NO: 35260 - DNA, 23 bp, Homo sapiens
catgctgacctccctcctgcccc

SEQ ID NO: 35261 - DNA, 24 bp, Homo sapiens
catgctgacctccctcctgcccca

SEQ ID NO: 35262 - DNA, 26 bp, Homo sapiens
catgctgacctccctcctgccccagg

SEQ ID NO: 35263 - DNA, 28 bp, Homo sapiens
catgctgacctccctcctgccccaggtt

SEQ ID NO: 35264 - DNA, 20 bp, Homo sapiens
atgctgacctccctcctgcc

SEQ ID NO: 35265 - DNA, 25 bp, Homo sapiens
atgctgacctccctcctgccccagg

SEQ ID NO: 35266 - DNA, 26 bp, Homo sapiens
atgctgacctccctcctgccccaggt

SEQ ID NO: 35267 - DNA, 21 bp, Homo sapiens
ctgacctccctcctgccccag

SEQ ID NO: 35268 - DNA, 25 bp, Homo sapiens
cccatcacctttccgtctcccctag

SEQ ID NO: 35269 - DNA, 24 bp, Homo sapiens
cccatcacctttccgtctccccta

SEQ ID NO: 35270 - DNA, 22 bp, Homo sapiens
cccatcacctttccgtctcccc

SEQ ID NO: 35271 - DNA, 21 bp, Homo sapiens
cccatcacctttccgtctccc

SEQ ID NO: 35272 - DNA, 20 bp, Homo sapiens
cccatcacctttccgtctcc

SEQ ID NO: 35273 - DNA, 17 bp, Homo sapiens
cccatcacctttccgtc

SEQ ID NO: 35274 - DNA, 16 bp, Homo sapiens
cccatcacctttccgt

SEQ ID NO: 35275 - DNA, 27 bp, Homo sapiens
gaggctgagaaggtgatgttggctcaa

SEQ ID NO: 35276 - DNA, 23 bp, Homo sapiens
ggctgagaaggtgatgttggctc

SEQ ID NO: 35277 - DNA, 25 bp, Homo sapiens
gaggctgagaaggtgatgttggctc

SEQ ID NO: 35278 - DNA, 26 bp, Homo sapiens
agaggctgagaaggtgatgttggctc

SEQ ID NO: 35279 - DNA, 27 bp, Homo sapiens
cagaggctgagaaggtgatgttggctc

SEQ ID NO: 35280 - DNA, 25 bp, Homo sapiens
agaggctgagaaggtgatgttggct

SEQ ID NO: 35281 - DNA, 26 bp, Homo sapiens
cagaggctgagaaggtgatgttggct

SEQ ID NO: 35282 - DNA, 27 bp, Homo sapiens
gcagaggctgagaaggtgatgttggct

SEQ ID NO: 35283 - DNA, 24 bp, Homo sapiens
agaggctgagaaggtgatgttggc

SEQ ID NO: 35284 - DNA, 23 bp, Homo sapiens
agaggctgagaaggtgatgttgg

SEQ ID NO: 35285 - DNA, 24 bp, Homo sapiens
cagaggctgagaaggtgatgttgg

SEQ ID NO: 35286 - DNA, 23 bp, Homo sapiens
cagaggctgagaaggtgatgttg

SEQ ID NO: 35287 - DNA, 21 bp, Homo sapiens
agaggctgagaaggtgatgtt

SEQ ID NO: 35288 - DNA, 20 bp, Homo sapiens
agaggctgagaaggtgatgt

SEQ ID NO: 35289 - DNA, 23 bp, Homo sapiens
ttttagaggctggaatagagatt

SEQ ID NO: 35290 - DNA, 22 bp, Homo sapiens
tttagaggctggaatagagatt

SEQ ID NO: 35291 - DNA, 24 bp, Homo sapiens
tttagaggctggaatagagattct

SEQ ID NO: 35292 - DNA, 25 bp, Homo sapiens
tttagaggctggaatagagattctt

SEQ ID NO: 35293 - DNA, 20 bp, Homo sapiens
ttagaggctggaatagagat

SEQ ID NO: 35294 - DNA, 21 bp, Homo sapiens
ttagaggctggaatagagatt

SEQ ID NO: 35295 - DNA, 22 bp, Homo sapiens
ttagaggctggaatagagattc

SEQ ID NO: 35296 - DNA, 24 bp, Homo sapiens
ttagaggctggaatagagattctt

SEQ ID NO: 35297 - DNA, 22 bp, Homo sapiens
tagaggctggaatagagattct

SEQ ID NO: 35298 - DNA, 23 bp, Homo sapiens
tagaggctggaatagagattctt

SEQ ID NO: 35299 - DNA, 20 bp, Homo sapiens
aggctggaatagagattctt

SEQ ID NO: 35300 - DNA, 21 bp, Homo sapiens
aggctggaatagagattcttg

SEQ ID NO: 35301 - DNA, 24 bp, Homo sapiens
ggatccctttatctgtcctctagg

SEQ ID NO: 35302 - DNA, 18 bp, Homo sapiens
gatccctttatctgtcct

SEQ ID NO: 35303 - DNA, 20 bp, Homo sapiens
gatccctttatctgtcctct

SEQ ID NO: 35304 - DNA, 21 bp, Homo sapiens
gatccctttatctgtcctcta

SEQ ID NO: 35305 - DNA, 23 bp, Homo sapiens
gatccctttatctgtcctctagg

SEQ ID NO: 35306 - DNA, 24 bp, Homo sapiens
gatccctttatctgtcctctagga

SEQ ID NO: 35307 - DNA, 21 bp, Homo sapiens
atccctttatctgtcctctag

SEQ ID NO: 35308 - DNA, 22 bp, Homo sapiens
atccctttatctgtcctctagg

SEQ ID NO: 35309 - DNA, 23 bp, Homo sapiens
atccctttatctgtcctctagga

SEQ ID NO: 35310 - DNA, 21 bp, Homo sapiens
ggtgtgtgtgtagaggaagaa

SEQ ID NO: 35311 - DNA, 28 bp, Homo sapiens
ggtgtgtgtgtagaggaagaagggaagc

SEQ ID NO: 35312 - DNA, 24 bp, Homo sapiens
gtgtgtgtgtagaggaagaaggga

SEQ ID NO: 35313 - DNA, 25 bp, Homo sapiens
gtgtgtgtgtagaggaagaagggaa

SEQ ID NO: 35314 - DNA, 27 bp, Homo sapiens
gtgtgtgtgtagaggaagaagggaagc

SEQ ID NO: 35315 - DNA, 20 bp, Homo sapiens
tgtgtgtgtagaggaagaag

SEQ ID NO: 35316 - DNA, 21 bp, Homo sapiens
tgtgtgtgtagaggaagaagg

SEQ ID NO: 35317 - DNA, 22 bp, Homo sapiens
tgtgtgtgtagaggaagaaggg

SEQ ID NO: 35318 - DNA, 24 bp, Homo sapiens
tgtgtgtgtagaggaagaagggaa

SEQ ID NO: 35319 - DNA, 25 bp, Homo sapiens
tgtgtgtgtagaggaagaagggaag

SEQ ID NO: 35320 - DNA, 26 bp, Homo sapiens
tgtgtgtgtagaggaagaagggaagc

SEQ ID NO: 35321 - DNA, 22 bp, Homo sapiens
gtgtgtgtagaggaagaaggga

SEQ ID NO: 35322 - DNA, 19 bp, Homo sapiens
tgtgtgtagaggaagaagg

SEQ ID NO: 35323 - DNA, 21 bp, Homo sapiens
gactgcctctccctctttacc

SEQ ID NO: 35324 - DNA, 20 bp, Homo sapiens
cctctccctctttacccact

SEQ ID NO: 35325 - DNA, 22 bp, Homo sapiens
cctctccctctttacccactag

SEQ ID NO: 35326 - DNA, 23 bp, Homo sapiens
cctctccctctttacccactagg

SEQ ID NO: 35327 - DNA, 22 bp, Homo sapiens
ctctccctctttacccactagg

SEQ ID NO: 35328 - DNA, 21 bp, Homo sapiens
tctccctctttacccactagg

SEQ ID NO: 35329 - DNA, 23 bp, Homo sapiens
accgactctgtctcctgcagatc

SEQ ID NO: 35330 - DNA, 24 bp, Homo sapiens
caccgactctgtctcctgcagatc

SEQ ID NO: 35331 - DNA, 23 bp, Homo sapiens
caccgactctgtctcctgcagat

SEQ ID NO: 35332 - DNA, 22 bp, Homo sapiens
caccgactctgtctcctgcaga

SEQ ID NO: 35333 - DNA, 20 bp, Homo sapiens
caccgactctgtctcctgca

SEQ ID NO: 35334 - DNA, 19 bp, Homo sapiens
caccgactctgtctcctgc

SEQ ID NO: 35335 - DNA, 18 bp, Homo sapiens
caccgactctgtctcctg

SEQ ID NO: 35336 - DNA, 17 bp, Homo sapiens
caccgactctgtctcct

SEQ ID NO: 35337 - DNA, 25 bp, Homo sapiens
agcaggggagagagaggagtcctct

SEQ ID NO: 35338 - DNA, 24 bp, Homo sapiens
agcaggggagagagaggagtcctc

SEQ ID NO: 35339 - DNA, 25 bp, Homo sapiens
cagcaggggagagagaggagtcctc

SEQ ID NO: 35340 - DNA, 23 bp, Homo sapiens
agcaggggagagagaggagtcct

SEQ ID NO: 35341 - DNA, 24 bp, Homo sapiens
cagcaggggagagagaggagtcct

SEQ ID NO: 35342 - DNA, 22 bp, Homo sapiens
agcaggggagagagaggagtcc

SEQ ID NO: 35343 - DNA, 21 bp, Homo sapiens
cagcaggggagagagaggagt

SEQ ID NO: 35344 - DNA, 20 bp, Homo sapiens
cagcaggggagagagaggag

SEQ ID NO: 35345 - DNA, 19 bp, Homo sapiens
cagcaggggagagagagga

SEQ ID NO: 35346 - DNA, 23 bp, Homo sapiens
caaaagttattgcggttttggct

SEQ ID NO: 35347 - DNA, 21 bp, Homo sapiens
aaaagttattgcggttttggc

SEQ ID NO: 35348 - DNA, 23 bp, Homo sapiens
aaaagttattgcggttttggctg

SEQ ID NO: 35349 - DNA, 25 bp, Homo sapiens
aaaagttattgcggttttggctgcc

SEQ ID NO: 35350 - DNA, 20 bp, Homo sapiens
aaagttattgcggttttggc

SEQ ID NO: 35351 - DNA, 22 bp, Homo sapiens
aaagttattgcggttttggctg

SEQ ID NO: 35352 - DNA, 20 bp, Homo sapiens
ggccaaaaccgcagtaactt

SEQ ID NO: 35353 - DNA, 21 bp, Homo sapiens
ccaaaaccgcagtaacttttg

SEQ ID NO: 35354 - DNA, 22 bp, Homo sapiens
ccaaaaccgcagtaacttttgt

SEQ ID NO: 35355 - DNA, 23 bp, Homo sapiens
ccaaaaccgcagtaacttttgtg

SEQ ID NO: 35356 - DNA, 20 bp, Homo sapiens
caaaaccgcagtaacttttg

SEQ ID NO: 35357 - DNA, 22 bp, Homo sapiens
caaaaccgcagtaacttttgtg

SEQ ID NO: 35358 - DNA, 23 bp, Homo sapiens
caaaaccgcagtaacttttgtgc

SEQ ID NO: 35359 - DNA, 22 bp, Homo sapiens
aaaccgcagtaacttttgtgcc

SEQ ID NO: 35360 - DNA, 18 bp, Homo sapiens
tagagcagggggatggca

SEQ ID NO: 35361 - DNA, 22 bp, Homo sapiens
cagggggatggcagagcaaaat

SEQ ID NO: 35362 - DNA, 23 bp, Homo sapiens
cagggggatggcagagcaaaatt

SEQ ID NO: 35363 - DNA, 24 bp, Homo sapiens
cagggggatggcagagcaaaattc

SEQ ID NO: 35364 - DNA, 25 bp, Homo sapiens
cagggggatggcagagcaaaattca

SEQ ID NO: 35365 - DNA, 27 bp, Homo sapiens
cagggggatggcagagcaaaattcatg

SEQ ID NO: 35366 - DNA, 20 bp, Homo sapiens
agggggatggcagagcaaaa

SEQ ID NO: 35367 - DNA, 21 bp, Homo sapiens
agggggatggcagagcaaaat

SEQ ID NO: 35368 - DNA, 23 bp, Homo sapiens
agggggatggcagagcaaaattc

SEQ ID NO: 35369 - DNA, 24 bp, Homo sapiens
agggggatggcagagcaaaattca

SEQ ID NO: 35370 - DNA, 24 bp, Homo sapiens
attttgtgtctcccattccccaga

SEQ ID NO: 35371 - DNA, 25 bp, Homo sapiens
attttgtgtctcccattccccagag

SEQ ID NO: 35372 - DNA, 26 bp, Homo sapiens
attttgtgtctcccattccccagagc

SEQ ID NO: 35373 - DNA, 20 bp, Homo sapiens
ttttgtgtctcccattcccc

SEQ ID NO: 35374 - DNA, 21 bp, Homo sapiens
ttttgtgtctcccattcccca

SEQ ID NO: 35375 - DNA, 23 bp, Homo sapiens
ttttgtgtctcccattccccaga

SEQ ID NO: 35376 - DNA, 24 bp, Homo sapiens
ttttgtgtctcccattccccagag

SEQ ID NO: 35377 - DNA, 25 bp, Homo sapiens
ttttgtgtctcccattccccagagc

SEQ ID NO: 35378 - DNA, 22 bp, Homo sapiens
tttgtgtctcccattccccaga

SEQ ID NO: 35379 - DNA, 24 bp, Homo sapiens
tttgtgtctcccattccccagagc

SEQ ID NO: 35380 - DNA, 24 bp, Homo sapiens
ctcctctgttttctttcctagata

SEQ ID NO: 35381 - DNA, 23 bp, Homo sapiens
ctcctctgttttctttcctagat

SEQ ID NO: 35382 - DNA, 22 bp, Homo sapiens
ctcctctgttttctttcctaga

SEQ ID NO: 35383 - DNA, 23 bp, Homo sapiens
cctcctctgttttctttcctaga

SEQ ID NO: 35384 - DNA, 23 bp, Homo sapiens
tcctcctctgttttctttcctag

SEQ ID NO: 35385 - DNA, 22 bp, Homo sapiens
tcctcctctgttttctttccta

SEQ ID NO: 35386 - DNA, 19 bp, Homo sapiens
ctcctctgttttctttcct

SEQ ID NO: 35387 - DNA, 21 bp, Homo sapiens
tcctcctctgttttctttcct

SEQ ID NO: 35388 - DNA, 27 bp, Homo sapiens
tgggagggaagacagctggagagtatg

SEQ ID NO: 35389 - DNA, 28 bp, Homo sapiens
ttgggagggaagacagctggagagtatg

SEQ ID NO: 35390 - DNA, 27 bp, Homo sapiens
ttgggagggaagacagctggagagtat

SEQ ID NO: 35391 - DNA, 26 bp, Homo sapiens
ttgggagggaagacagctggagagta

SEQ ID NO: 35392 - DNA, 23 bp, Homo sapiens
gggagggaagacagctggagagt

SEQ ID NO: 35393 - DNA, 24 bp, Homo sapiens
tgggagggaagacagctggagagt

SEQ ID NO: 35394 - DNA, 25 bp, Homo sapiens
ttgggagggaagacagctggagagt

SEQ ID NO: 35395 - DNA, 23 bp, Homo sapiens
tgggagggaagacagctggagag

SEQ ID NO: 35396 - DNA, 24 bp, Homo sapiens
ttgggagggaagacagctggagag

SEQ ID NO: 35397 - DNA, 22 bp, Homo sapiens
tgggagggaagacagctggaga

SEQ ID NO: 35398 - DNA, 24 bp, Homo sapiens
cttgggagggaagacagctggaga

SEQ ID NO: 35399 - DNA, 22 bp, Homo sapiens
ttgggagggaagacagctggag

SEQ ID NO: 35400 - DNA, 25 bp, Homo sapiens
cacttgggagggaagacagctggag

SEQ ID NO: 35401 - DNA, 25 bp, Homo sapiens
tgcctcttttccacggcctcaggga

SEQ ID NO: 35402 - DNA, 24 bp, Homo sapiens
tgcctcttttccacggcctcaggg

SEQ ID NO: 35403 - DNA, 22 bp, Homo sapiens
gcctcttttccacggcctcagg

SEQ ID NO: 35404 - DNA, 23 bp, Homo sapiens
tgcctcttttccacggcctcagg

SEQ ID NO: 35405 - DNA, 23 bp, Homo sapiens
ttgcctcttttccacggcctcag

SEQ ID NO: 35406 - DNA, 21 bp, Homo sapiens
tgcctcttttccacggcctca

SEQ ID NO: 35407 - DNA, 27 bp, Homo sapiens
cgggccggaggtcaagggcgtcgcttc

SEQ ID NO: 35408 - DNA, 26 bp, Homo sapiens
cgggccggaggtcaagggcgtcgctt

SEQ ID NO: 35409 - DNA, 25 bp, Homo sapiens
cgggccggaggtcaagggcgtcgct

SEQ ID NO: 35410 - DNA, 24 bp, Homo sapiens
cgggccggaggtcaagggcgtcgc

SEQ ID NO: 35411 - DNA, 23 bp, Homo sapiens
cgggccggaggtcaagggcgtcg

SEQ ID NO: 35412 - DNA, 24 bp, Homo sapiens
ccgggccggaggtcaagggcgtcg

SEQ ID NO: 35413 - DNA, 22 bp, Homo sapiens
cgggccggaggtcaagggcgtc

SEQ ID NO: 35414 - DNA, 23 bp, Homo sapiens
ccgggccggaggtcaagggcgtc

SEQ ID NO: 35415 - DNA, 19 bp, Homo sapiens
cccgggccggaggtcaagg

SEQ ID NO: 35416 - DNA, 19 bp, Homo sapiens
accccgggccggaggtcaa

SEQ ID NO: 35417 - DNA, 23 bp, Homo sapiens
ttctctttgccaaggacagatct

SEQ ID NO: 35418 - DNA, 25 bp, Homo sapiens
ttctctttgccaaggacagatctga

SEQ ID NO: 35419 - DNA, 24 bp, Homo sapiens
tttgtgtccccatcctgcagaaac

SEQ ID NO: 35420 - DNA, 20 bp, Homo sapiens
tttgtgtccccatcctgcag

SEQ ID NO: 35421 - DNA, 24 bp, Homo sapiens
cacctttgtgtccccatcctgcag

SEQ ID NO: 35422 - DNA, 22 bp, Homo sapiens
acctttgtgtccccatcctgca

SEQ ID NO: 35423 - DNA, 21 bp, Homo sapiens
acctttgtgtccccatcctgc

SEQ ID NO: 35424 - DNA, 22 bp, Homo sapiens
cacctttgtgtccccatcctgc

SEQ ID NO: 35425 - DNA, 23 bp, Homo sapiens
ccacctttgtgtccccatcctgc

SEQ ID NO: 35426 - DNA, 21 bp, Homo sapiens
cacctttgtgtccccatcctg

SEQ ID NO: 35427 - DNA, 20 bp, Homo sapiens
cacctttgtgtccccatcct

SEQ ID NO: 35428 - DNA, 22 bp, Homo sapiens
ctgccacctttgtgtccccatc

SEQ ID NO: 35429 - DNA, 21 bp, Homo sapiens
tgggggaattcaggggtgtcg

SEQ ID NO: 35430 - DNA, 26 bp, Homo sapiens
taggggtgggggaattcaggggtgtc

SEQ ID NO: 35431 - DNA, 24 bp, Homo sapiens
taggggtgggggaattcaggggtg

SEQ ID NO: 35432 - DNA, 23 bp, Homo sapiens
taggggtgggggaattcaggggt

SEQ ID NO: 35433 - DNA, 20 bp, Homo sapiens
taggggtgggggaattcagg

SEQ ID NO: 35434 - DNA, 17 bp, Homo sapiens
gtggggtaggggtgggg

SEQ ID NO: 35435 - DNA, 24 bp, Homo sapiens
tcctgggcttctcctctgtagcca

SEQ ID NO: 35436 - DNA, 23 bp, Homo sapiens
tcctgggcttctcctctgtagcc

SEQ ID NO: 35437 - DNA, 22 bp, Homo sapiens
tcctgggcttctcctctgtagc

SEQ ID NO: 35438 - DNA, 23 bp, Homo sapiens
ttcctgggcttctcctctgtagc

SEQ ID NO: 35439 - DNA, 21 bp, Homo sapiens
tcctgggcttctcctctgtag

SEQ ID NO: 35440 - DNA, 20 bp, Homo sapiens
ttcctgggcttctcctctgt

SEQ ID NO: 35441 - DNA, 22 bp, Homo sapiens
cgttcctgggcttctcctctgt

SEQ ID NO: 35442 - DNA, 21 bp, Homo sapiens
cgttcctgggcttctcctctg

SEQ ID NO: 35443 - DNA, 23 bp, Homo sapiens
gggaaaagtcctgatccgggaac

SEQ ID NO: 35444 - DNA, 27 bp, Homo sapiens
ttaggggaaaagtcctgatccgggaac

SEQ ID NO: 35445 - DNA, 25 bp, Homo sapiens
taggggaaaagtcctgatccgggaa

SEQ ID NO: 35446 - DNA, 24 bp, Homo sapiens
taggggaaaagtcctgatccggga

SEQ ID NO: 35447 - DNA, 23 bp, Homo sapiens
taggggaaaagtcctgatccggg

SEQ ID NO: 35448 - DNA, 23 bp, Homo sapiens
ttaggggaaaagtcctgatccgg

SEQ ID NO: 35449 - DNA, 21 bp, Homo sapiens
taggggaaaagtcctgatccg

SEQ ID NO: 35450 - DNA, 22 bp, Homo sapiens
ttaggggaaaagtcctgatccg

SEQ ID NO: 35451 - DNA, 21 bp, Homo sapiens
ttaggggaaaagtcctgatcc

SEQ ID NO: 35452 - DNA, 20 bp, Homo sapiens
ttaggggaaaagtcctgatc

SEQ ID NO: 35453 - DNA, 19 bp, Homo sapiens
caactctgccccagggaac

SEQ ID NO: 35454 - DNA, 25 bp, Homo sapiens
tctcaccccaactctgccccaggga

SEQ ID NO: 35455 - DNA, 23 bp, Homo sapiens
ctcaccccaactctgccccaggg

SEQ ID NO: 35456 - DNA, 24 bp, Homo sapiens
tctcaccccaactctgccccaggg

SEQ ID NO: 35457 - DNA, 22 bp, Homo sapiens
ctcaccccaactctgccccagg

SEQ ID NO: 35458 - DNA, 23 bp, Homo sapiens
tctcaccccaactctgccccagg

SEQ ID NO: 35459 - DNA, 24 bp, Homo sapiens
gtctcaccccaactctgccccagg

SEQ ID NO: 35460 - DNA, 23 bp, Homo sapiens
gtctcaccccaactctgccccag

SEQ ID NO: 35461 - DNA, 21 bp, Homo sapiens
tctcaccccaactctgcccca

SEQ ID NO: 35462 - DNA, 21 bp, Homo sapiens
gtctcaccccaactctgcccc

SEQ ID NO: 35463 - DNA, 17 bp, Homo sapiens
gtctcaccccaactctg

SEQ ID NO: 35464 - DNA, 24 bp, Homo sapiens
cggggctttgggtgagggaccccc

SEQ ID NO: 35465 - DNA, 22 bp, Homo sapiens
ccggggctttgggtgagggacc

SEQ ID NO: 35466 - DNA, 20 bp, Homo sapiens
cggggctttgggtgagggac

SEQ ID NO: 35467 - DNA, 21 bp, Homo sapiens
acttcagtgggatttctgagt

SEQ ID NO: 35468 - DNA, 24 bp, Homo sapiens
acttcagtgggatttctgagtagc

SEQ ID NO: 35469 - DNA, 25 bp, Homo sapiens
ttcagtgggatttctgagtagcatc

SEQ ID NO: 35470 - DNA, 22 bp, Homo sapiens
tcagtgggatttctgagtagca

SEQ ID NO: 35471 - DNA, 24 bp, Homo sapiens
tcagtgggatttctgagtagcatc

SEQ ID NO: 35472 - DNA, 21 bp, Homo sapiens
agtgggatttctgagtagcat

SEQ ID NO: 35473 - DNA, 22 bp, Homo sapiens
gtgggatttctgagtagcatcc

SEQ ID NO: 35474 - DNA, 19 bp, Homo sapiens
tgggatttctgagtagcat

SEQ ID NO: 35475 - DNA, 20 bp, Homo sapiens
tgggatttctgagtagcatc

SEQ ID NO: 35476 - DNA, 21 bp, Homo sapiens
tgggatttctgagtagcatcc

SEQ ID NO: 35477 - DNA, 22 bp, Homo sapiens
tgggatttctgagtagcatcct

SEQ ID NO: 35478 - DNA, 20 bp, Homo sapiens
gatgctactcggaaatccca

SEQ ID NO: 35479 - DNA, 21 bp, Homo sapiens
gatgctactcggaaatcccac

SEQ ID NO: 35480 - DNA, 22 bp, Homo sapiens
gatgctactcggaaatcccact

SEQ ID NO: 35481 - DNA, 23 bp, Homo sapiens
gatgctactcggaaatcccactg

SEQ ID NO: 35482 - DNA, 19 bp, Homo sapiens
atgctactcggaaatccca

SEQ ID NO: 35483 - DNA, 22 bp, Homo sapiens
atgctactcggaaatcccactg

SEQ ID NO: 35484 - DNA, 24 bp, Homo sapiens
atgctactcggaaatcccactgaa

SEQ ID NO: 35485 - DNA, 25 bp, Homo sapiens
atgctactcggaaatcccactgaag

SEQ ID NO: 35486 - DNA, 27 bp, Homo sapiens
atgctactcggaaatcccactgaagtc

SEQ ID NO: 35487 - DNA, 22 bp, Homo sapiens
tgctactcggaaatcccactga

SEQ ID NO: 35488 - DNA, 26 bp, Homo sapiens
tgctactcggaaatcccactgaagtc

SEQ ID NO: 35489 - DNA, 19 bp, Homo sapiens
ctactcggaaatcccactg

SEQ ID NO: 35490 - DNA, 20 bp, Homo sapiens
ctactcggaaatcccactga

SEQ ID NO: 35491 - DNA, 24 bp, Homo sapiens
tcagtgcatgacagaacttgggcc

SEQ ID NO: 35492 - DNA, 23 bp, Homo sapiens
tcagtgcatgacagaacttgggc

SEQ ID NO: 35493 - DNA, 22 bp, Homo sapiens
tcagtgcatgacagaacttggg

SEQ ID NO: 35494 - DNA, 20 bp, Homo sapiens
tcagtgcatgacagaacttg

SEQ ID NO: 35495 - DNA, 19 bp, Homo sapiens
tcagtgcatgacagaactt

SEQ ID NO: 35496 - DNA, 27 bp, Homo sapiens
aggttctgtgatacactccgactcggg

SEQ ID NO: 35497 - DNA, 28 bp, Homo sapiens
caggttctgtgatacactccgactcggg

SEQ ID NO: 35498 - DNA, 25 bp, Homo sapiens
aggttctgtgatacactccgactcg

SEQ ID NO: 35499 - DNA, 24 bp, Homo sapiens
aggttctgtgatacactccgactc

SEQ ID NO: 35500 - DNA, 25 bp, Homo sapiens
caggttctgtgatacactccgactc

SEQ ID NO: 35501 - DNA, 22 bp, Homo sapiens
ggttctgtgatacactccgact

SEQ ID NO: 35502 - DNA, 24 bp, Homo sapiens
caggttctgtgatacactccgact

SEQ ID NO: 35503 - DNA, 22 bp, Homo sapiens
aggttctgtgatacactccgac

SEQ ID NO: 35504 - DNA, 23 bp, Homo sapiens
caggttctgtgatacactccgac

SEQ ID NO: 35505 - DNA, 22 bp, Homo sapiens
caggttctgtgatacactccga

SEQ ID NO: 35506 - DNA, 20 bp, Homo sapiens
caggttctgtgatacactcc

SEQ ID NO: 35507 - DNA, 18 bp, Homo sapiens
aggatgcagctcaagcca

SEQ ID NO: 35508 - DNA, 27 bp, Homo sapiens
ttcctccccggagccaggatgcagctc

SEQ ID NO: 35509 - DNA, 21 bp, Homo sapiens
ttcctccccggagccaggatg

SEQ ID NO: 35510 - DNA, 23 bp, Homo sapiens
aaattcgtatctaggggaatatg

SEQ ID NO: 35511 - DNA, 24 bp, Homo sapiens
caaattcgtatctaggggaatatg

SEQ ID NO: 35512 - DNA, 22 bp, Homo sapiens
aaattcgtatctaggggaatat

SEQ ID NO: 35513 - DNA, 23 bp, Homo sapiens
caaattcgtatctaggggaatat

SEQ ID NO: 35514 - DNA, 20 bp, Homo sapiens
aattcgtatctaggggaata

SEQ ID NO: 35515 - DNA, 21 bp, Homo sapiens
aaattcgtatctaggggaata

SEQ ID NO: 35516 - DNA, 20 bp, Homo sapiens
aaattcgtatctaggggaat

SEQ ID NO: 35517 - DNA, 21 bp, Homo sapiens
caaattcgtatctaggggaat

SEQ ID NO: 35518 - DNA, 20 bp, Homo sapiens
caaattcgtatctaggggaa

SEQ ID NO: 35519 - DNA, 22 bp, Homo sapiens
cacaaattcgtatctaggggaa

SEQ ID NO: 35520 - DNA, 19 bp, Homo sapiens
caaattcgtatctagggga

SEQ ID NO: 35521 - DNA, 22 bp, Homo sapiens
tcacaaattcgtatctagggga

SEQ ID NO: 35522 - DNA, 26 bp, Homo sapiens
accctgtagatccgaatttgtgtaag

SEQ ID NO: 35523 - DNA, 27 bp, Homo sapiens
taccctgtagatccgaatttgtgtaag

SEQ ID NO: 35524 - DNA, 25 bp, Homo sapiens
taccctgtagatccgaatttgtgta

SEQ ID NO: 35525 - DNA, 23 bp, Homo sapiens
accctgtagatccgaatttgtgt

SEQ ID NO: 35526 - DNA, 24 bp, Homo sapiens
taccctgtagatccgaatttgtgt

SEQ ID NO: 35527 - DNA, 22 bp, Homo sapiens
accctgtagatccgaatttgtg

SEQ ID NO: 35528 - DNA, 21 bp, Homo sapiens
accctgtagatccgaatttgt

SEQ ID NO: 35529 - DNA, 22 bp, Homo sapiens
taccctgtagatccgaatttgt

SEQ ID NO: 35530 - DNA, 21 bp, Homo sapiens
taccctgtagatccgaatttg

SEQ ID NO: 35531 - DNA, 19 bp, Homo sapiens
accctgtagatccgaattt

SEQ ID NO: 35532 - DNA, 20 bp, Homo sapiens
taccctgtagatccgaattt

SEQ ID NO: 35533 - DNA, 18 bp, Homo sapiens
accctgtagatccgaatt

SEQ ID NO: 35534 - DNA, 20 bp, Homo sapiens
ttcatgttgttgggcctggg

SEQ ID NO: 35535 - DNA, 21 bp, Homo sapiens
tttcatgttgttgggcctggg

SEQ ID NO: 35536 - DNA, 23 bp, Homo sapiens
gtagtttcatgttgttgggcctg

SEQ ID NO: 35537 - DNA, 26 bp, Homo sapiens
taggtagtttcatgttgttgggcctg

SEQ ID NO: 35538 - DNA, 22 bp, Homo sapiens
gtagtttcatgttgttgggcct

SEQ ID NO: 35539 - DNA, 24 bp, Homo sapiens
aggtagtttcatgttgttgggcct

SEQ ID NO: 35540 - DNA, 25 bp, Homo sapiens
taggtagtttcatgttgttgggcct

SEQ ID NO: 35541 - DNA, 21 bp, Homo sapiens
gtagtttcatgttgttgggcc

SEQ ID NO: 35542 - DNA, 23 bp, Homo sapiens
aggtagtttcatgttgttgggcc

SEQ ID NO: 35543 - DNA, 24 bp, Homo sapiens
taggtagtttcatgttgttgggcc

SEQ ID NO: 35544 - DNA, 20 bp, Homo sapiens
gtagtttcatgttgttgggc

SEQ ID NO: 35545 - DNA, 22 bp, Homo sapiens
aggtagtttcatgttgttgggc

SEQ ID NO: 35546 - DNA, 23 bp, Homo sapiens
taggtagtttcatgttgttgggc

SEQ ID NO: 35547 - DNA, 21 bp, Homo sapiens
taggtagtttcatgttgttgg

SEQ ID NO: 35548 - DNA, 24 bp, Homo sapiens
aattaggtagtttcatgttgttgg

SEQ ID NO: 35549 - DNA, 22 bp, Homo sapiens
gaagaaggcggtcggtctgcgg

SEQ ID NO: 35550 - DNA, 22 bp, Homo sapiens
tgagggagttgggtgtatagga

SEQ ID NO: 35551 - DNA, 23 bp, Homo sapiens
gtgagggagttgggtgtatagga

SEQ ID NO: 35552 - DNA, 21 bp, Homo sapiens
tgagggagttgggtgtatagg

SEQ ID NO: 35553 - DNA, 20 bp, Homo sapiens
tgagggagttgggtgtatag

SEQ ID NO: 35554 - DNA, 21 bp, Homo sapiens
gtgagggagttgggtgtatag

SEQ ID NO: 35555 - DNA, 24 bp, Homo sapiens
ttccagtgagggagttgggtgtat

SEQ ID NO: 35556 - DNA, 19 bp, Homo sapiens
gcaggtcagcaggaggtga

SEQ ID NO: 35557 - DNA, 19 bp, Homo sapiens
tctctcccttcagggccgg

SEQ ID NO: 35558 - DNA, 26 bp, Homo sapiens
tgagacttctctcccttcagggccgg

SEQ ID NO: 35559 - DNA, 18 bp, Homo sapiens
cttctctcccttcagggc

SEQ ID NO: 35560 - DNA, 24 bp, Homo sapiens
gtgagacttctctcccttcagggc

SEQ ID NO: 35561 - DNA, 23 bp, Homo sapiens
gtgagacttctctcccttcaggg

SEQ ID NO: 35562 - DNA, 21 bp, Homo sapiens
tgagacttctctcccttcagg

SEQ ID NO: 35563 - DNA, 22 bp, Homo sapiens
gtgagacttctctcccttcagg

SEQ ID NO: 35564 - DNA, 27 bp, Homo sapiens
ttgaagggacaagtcagatatgccatt

SEQ ID NO: 35565 - DNA, 24 bp, Homo sapiens
tgaagggacaagtcagatatgcca

SEQ ID NO: 35566 - DNA, 25 bp, Homo sapiens
ttgaagggacaagtcagatatgcca

SEQ ID NO: 35567 - DNA, 23 bp, Homo sapiens
tgaagggacaagtcagatatgcc

SEQ ID NO: 35568 - DNA, 23 bp, Homo sapiens
ttgaagggacaagtcagatatgc

SEQ ID NO: 35569 - DNA, 21 bp, Homo sapiens
tgaagggacaagtcagatatg

SEQ ID NO: 35570 - DNA, 22 bp, Homo sapiens
ttgaagggacaagtcagatatg

SEQ ID NO: 35571 - DNA, 23 bp, Homo sapiens
cctctttccctaccgcctacagc

SEQ ID NO: 35572 - DNA, 27 bp, Homo sapiens
acaccctctttccctaccgcctacagc

SEQ ID NO: 35573 - DNA, 25 bp, Homo sapiens
acaccctctttccctaccgcctaca

SEQ ID NO: 35574 - DNA, 24 bp, Homo sapiens
acaccctctttccctaccgcctac

SEQ ID NO: 35575 - DNA, 23 bp, Homo sapiens
acaccctctttccctaccgccta

SEQ ID NO: 35576 - DNA, 22 bp, Homo sapiens
acaccctctttccctaccgcct

SEQ ID NO: 35577 - DNA, 20 bp, Homo sapiens
acaccctctttccctaccgc

SEQ ID NO: 35578 - DNA, 20 bp, Homo sapiens
gaggagggacttcagatgct

SEQ ID NO: 35579 - DNA, 24 bp, Homo sapiens
taggtggcagaggagggacttcag

SEQ ID NO: 35580 - DNA, 26 bp, Homo sapiens
cataggtggcagaggagggacttcag

SEQ ID NO: 35581 - DNA, 24 bp, Homo sapiens
ataggtggcagaggagggacttca

SEQ ID NO: 35582 - DNA, 25 bp, Homo sapiens
cataggtggcagaggagggacttca

SEQ ID NO: 35583 - DNA, 24 bp, Homo sapiens
cataggtggcagaggagggacttc

SEQ ID NO: 35584 - DNA, 22 bp, Homo sapiens
ataggtggcagaggagggactt

SEQ ID NO: 35585 - DNA, 23 bp, Homo sapiens
cataggtggcagaggagggactt

SEQ ID NO: 35586 - DNA, 20 bp, Homo sapiens
taggtggcagaggagggact

SEQ ID NO: 35587 - DNA, 21 bp, Homo sapiens
ataggtggcagaggagggact

SEQ ID NO: 35588 - DNA, 22 bp, Homo sapiens
cataggtggcagaggagggact

SEQ ID NO: 35589 - DNA, 23 bp, Homo sapiens
ccataggtggcagaggagggact

SEQ ID NO: 35590 - DNA, 20 bp, Homo sapiens
ataggtggcagaggagggac

SEQ ID NO: 35591 - DNA, 23 bp, Homo sapiens
tccataggtggcagaggagggac

SEQ ID NO: 35592 - DNA, 20 bp, Homo sapiens
cataggtggcagaggaggga

SEQ ID NO: 35593 - DNA, 21 bp, Homo sapiens
ccataggtggcagaggaggga

SEQ ID NO: 35594 - DNA, 20 bp, Homo sapiens
ccataggtggcagaggaggg

SEQ ID NO: 35595 - DNA, 18 bp, Homo sapiens
catccataggtggcagag

SEQ ID NO: 35596 - DNA, 17 bp, Homo sapiens
catccataggtggcaga

SEQ ID NO: 35597 - DNA, 22 bp, Homo sapiens
ccttcagatcttggtgttttga

SEQ ID NO: 35598 - DNA, 25 bp, Homo sapiens
tagccttcagatcttggtgttttga

SEQ ID NO: 35599 - DNA, 21 bp, Homo sapiens
ccttcagatcttggtgttttg

SEQ ID NO: 35600 - DNA, 24 bp, Homo sapiens
tagccttcagatcttggtgttttg

SEQ ID NO: 35601 - DNA, 20 bp, Homo sapiens
ccttcagatcttggtgtttt

SEQ ID NO: 35602 - DNA, 19 bp, Homo sapiens
ccttcagatcttggtgttt

SEQ ID NO: 35603 - DNA, 22 bp, Homo sapiens
tagccttcagatcttggtgttt

SEQ ID NO: 35604 - DNA, 23 bp, Homo sapiens
gtagccttcagatcttggtgttt

SEQ ID NO: 35605 - DNA, 21 bp, Homo sapiens
tagccttcagatcttggtgtt

SEQ ID NO: 35606 - DNA, 22 bp, Homo sapiens
gtagccttcagatcttggtgtt

SEQ ID NO: 35607 - DNA, 25 bp, Homo sapiens
ggggtagccttcagatcttggtgtt

SEQ ID NO: 35608 - DNA, 20 bp, Homo sapiens
tagccttcagatcttggtgt

SEQ ID NO: 35609 - DNA, 21 bp, Homo sapiens
gtagccttcagatcttggtgt

SEQ ID NO: 35610 - DNA, 24 bp, Homo sapiens
ggggtagccttcagatcttggtgt

SEQ ID NO: 35611 - DNA, 22 bp, Homo sapiens
ggggtagccttcagatcttggt

SEQ ID NO: 35612 - DNA, 18 bp, Homo sapiens
tggggtagccttcagatc

SEQ ID NO: 35613 - DNA, 16 bp, Homo sapiens
tggggtagccttcaga

SEQ ID NO: 35614 - DNA, 18 bp, Homo sapiens
tgaaggctgcccctttgc

SEQ ID NO: 35615 - DNA, 21 bp, Homo sapiens
atctgaaggctgcccctttgc

SEQ ID NO: 35616 - DNA, 24 bp, Homo sapiens
cacttggatctgaaggctgcccct

SEQ ID NO: 35617 - DNA, 25 bp, Homo sapiens
ccacttggatctgaaggctgcccct

SEQ ID NO: 35618 - DNA, 20 bp, Homo sapiens
ttggatctgaaggctgcccc

SEQ ID NO: 35619 - DNA, 23 bp, Homo sapiens
cacttggatctgaaggctgcccc

SEQ ID NO: 35620 - DNA, 24 bp, Homo sapiens
ccacttggatctgaaggctgcccc

SEQ ID NO: 35621 - DNA, 25 bp, Homo sapiens
gccacttggatctgaaggctgcccc

SEQ ID NO: 35622 - DNA, 22 bp, Homo sapiens
ccacttggatctgaaggctgcc

SEQ ID NO: 35623 - DNA, 21 bp, Homo sapiens
ccacttggatctgaaggctgc

SEQ ID NO: 35624 - DNA, 20 bp, Homo sapiens
ccacttggatctgaaggctg

SEQ ID NO: 35625 - DNA, 19 bp, Homo sapiens
ccacttggatctgaaggct

SEQ ID NO: 35626 - DNA, 18 bp, Homo sapiens
ccacttggatctgaaggc

SEQ ID NO: 35627 - DNA, 17 bp, Homo sapiens
ccacttggatctgaagg

SEQ ID NO: 35628 - DNA, 19 bp, Homo sapiens
cttgggccacttggatctg

SEQ ID NO: 35629 - DNA, 22 bp, Homo sapiens
agtgtttcctactttatggatg

SEQ ID NO: 35630 - DNA, 24 bp, Homo sapiens
gtagtgtttcctactttatggatg

SEQ ID NO: 35631 - DNA, 25 bp, Homo sapiens
tgtagtgtttcctactttatggatg

SEQ ID NO: 35632 - DNA, 23 bp, Homo sapiens
gtagtgtttcctactttatggat

SEQ ID NO: 35633 - DNA, 24 bp, Homo sapiens
tgtagtgtttcctactttatggat

SEQ ID NO: 35634 - DNA, 22 bp, Homo sapiens
gtagtgtttcctactttatgga

SEQ ID NO: 35635 - DNA, 21 bp, Homo sapiens
gtagtgtttcctactttatgg

SEQ ID NO: 35636 - DNA, 22 bp, Homo sapiens
tgtagtgtttcctactttatgg

SEQ ID NO: 35637 - DNA, 20 bp, Homo sapiens
gtagtgtttcctactttatg

SEQ ID NO: 35638 - DNA, 19 bp, Homo sapiens
gtagtgtttcctactttat

SEQ ID NO: 35639 - DNA, 20 bp, Homo sapiens
tgtagtgtttcctactttat

SEQ ID NO: 35640 - DNA, 19 bp, Homo sapiens
tgtagtgtttcctacttta

SEQ ID NO: 35641 - DNA, 25 bp, Homo sapiens
cataaagtagaaagcactactaaca

SEQ ID NO: 35642 - DNA, 27 bp, Homo sapiens
cccataaagtagaaagcactactaaca

SEQ ID NO: 35643 - DNA, 23 bp, Homo sapiens
ataaagtagaaagcactactaac

SEQ ID NO: 35644 - DNA, 24 bp, Homo sapiens
cataaagtagaaagcactactaac

SEQ ID NO: 35645 - DNA, 21 bp, Homo sapiens
ataaagtagaaagcactacta

SEQ ID NO: 35646 - DNA, 22 bp, Homo sapiens
cataaagtagaaagcactacta

SEQ ID NO: 35647 - DNA, 20 bp, Homo sapiens
ataaagtagaaagcactact

SEQ ID NO: 35648 - DNA, 19 bp, Homo sapiens
ataaagtagaaagcactac

SEQ ID NO: 35649 - DNA, 20 bp, Homo sapiens
cataaagtagaaagcactac

SEQ ID NO: 35650 - DNA, 22 bp, Homo sapiens
cccataaagtagaaagcactac

SEQ ID NO: 35651 - DNA, 19 bp, Homo sapiens
cataaagtagaaagcacta

SEQ ID NO: 35652 - DNA, 21 bp, Homo sapiens
cccataaagtagaaagcacta

SEQ ID NO: 35653 - DNA, 20 bp, Homo sapiens
cccataaagtagaaagcact

SEQ ID NO: 35654 - DNA, 19 bp, Homo sapiens
cccataaagtagaaagcac

SEQ ID NO: 35655 - DNA, 16 bp, Homo sapiens
atctgggctgccatct

SEQ ID NO: 35656 - DNA, 17 bp, Homo sapiens
tatctgggctgccatct

SEQ ID NO: 35657 - DNA, 21 bp, Homo sapiens
aggttatctgggctgccatct

SEQ ID NO: 35658 - DNA, 23 bp, Homo sapiens
gcaggttatctgggctgccatct

SEQ ID NO: 35659 - DNA, 19 bp, Homo sapiens
aggttatctgggctgccat

SEQ ID NO: 35660 - DNA, 21 bp, Homo sapiens
gcaggttatctgggctgccat

SEQ ID NO: 35661 - DNA, 19 bp, Homo sapiens
caggttatctgggctgcca

SEQ ID NO: 35662 - DNA, 18 bp, Homo sapiens
caggttatctgggctgcc

SEQ ID NO: 35663 - DNA, 26 bp, Homo sapiens
tgcaatattgcttatagggttttggt

SEQ ID NO: 35664 - DNA, 23 bp, Homo sapiens
tgcaatattgcttatagggtttt

SEQ ID NO: 35665 - DNA, 22 bp, Homo sapiens
tgcaatattgcttatagggttt

SEQ ID NO: 35666 - DNA, 24 bp, Homo sapiens
agtgcaatattgcttatagggttt

SEQ ID NO: 35667 - DNA, 25 bp, Homo sapiens
tagtgcaatattgcttatagggttt

SEQ ID NO: 35668 - DNA, 21 bp, Homo sapiens
tgcaatattgcttatagggtt

SEQ ID NO: 35669 - DNA, 23 bp, Homo sapiens
agtgcaatattgcttatagggtt

SEQ ID NO: 35670 - DNA, 24 bp, Homo sapiens
tagtgcaatattgcttatagggtt

SEQ ID NO: 35671 - DNA, 20 bp, Homo sapiens
tgcaatattgcttatagggt

SEQ ID NO: 35672 - DNA, 22 bp, Homo sapiens
agtgcaatattgcttatagggt

SEQ ID NO: 35673 - DNA, 22 bp, Homo sapiens
tagtgcaatattgcttataggg

SEQ ID NO: 35674 - DNA, 20 bp, Homo sapiens
agtgcaatattgcttatagg

SEQ ID NO: 35675 - DNA, 21 bp, Homo sapiens
tagtgcaatattgcttatagg

SEQ ID NO: 35676 - DNA, 19 bp, Homo sapiens
agtgcaatattgcttatag

SEQ ID NO: 35677 - DNA, 20 bp, Homo sapiens
tagtgcaatattgcttatag

SEQ ID NO: 35678 - DNA, 18 bp, Homo sapiens
atattgtctctgctgtgt

SEQ ID NO: 35679 - DNA, 27 bp, Homo sapiens
accctatcaatattgtctctgctgtgt

SEQ ID NO: 35680 - DNA, 25 bp, Homo sapiens
accctatcaatattgtctctgctgt

SEQ ID NO: 35681 - DNA, 24 bp, Homo sapiens
accctatcaatattgtctctgctg

SEQ ID NO: 35682 - DNA, 23 bp, Homo sapiens
accctatcaatattgtctctgct

SEQ ID NO: 35683 - DNA, 21 bp, Homo sapiens
accctatcaatattgtctctg

SEQ ID NO: 35684 - DNA, 20 bp, Homo sapiens
accctatcaatattgtctct

SEQ ID NO: 35685 - DNA, 19 bp, Homo sapiens
accctatcaatattgtctc

SEQ ID NO: 35686 - DNA, 18 bp, Homo sapiens
accctatcaatattgtct

SEQ ID NO: 35687 - DNA, 26 bp, Homo sapiens
agtgcaatagtattgtcaaagcatct

SEQ ID NO: 35688 - DNA, 27 bp, Homo sapiens
cagtgcaatagtattgtcaaagcatct

SEQ ID NO: 35689 - DNA, 23 bp, Homo sapiens
tgcaatagtattgtcaaagcatc

SEQ ID NO: 35690 - DNA, 25 bp, Homo sapiens
agtgcaatagtattgtcaaagcatc

SEQ ID NO: 35691 - DNA, 26 bp, Homo sapiens
cagtgcaatagtattgtcaaagcatc

SEQ ID NO: 35692 - DNA, 25 bp, Homo sapiens
cagtgcaatagtattgtcaaagcat

SEQ ID NO: 35693 - DNA, 24 bp, Homo sapiens
cagtgcaatagtattgtcaaagca

SEQ ID NO: 35694 - DNA, 22 bp, Homo sapiens
cagtgcaatagtattgtcaaag

SEQ ID NO: 35695 - DNA, 21 bp, Homo sapiens
cagtgcaatagtattgtcaaa

SEQ ID NO: 35696 - DNA, 20 bp, Homo sapiens
cagtgcaatagtattgtcaa

SEQ ID NO: 35697 - DNA, 19 bp, Homo sapiens
cagtgcaatagtattgtca

SEQ ID NO: 35698 - DNA, 24 bp, Homo sapiens
gctctgactttattgcactactgt

SEQ ID NO: 35699 - DNA, 23 bp, Homo sapiens
gctctgactttattgcactactg

SEQ ID NO: 35700 - DNA, 21 bp, Homo sapiens
gctctgactttattgcactac

SEQ ID NO: 35701 - DNA, 20 bp, Homo sapiens
gctctgactttattgcacta

SEQ ID NO: 35702 - DNA, 19 bp, Homo sapiens
gctctgactttattgcact

SEQ ID NO: 35703 - DNA, 23 bp, Homo sapiens
gaatgctctgactttattgcact

SEQ ID NO: 35704 - DNA, 22 bp, Homo sapiens
gtttcctcatttatctgttggg

SEQ ID NO: 35705 - DNA, 24 bp, Homo sapiens
ttcctcatttatctgttgggaagc

SEQ ID NO: 35706 - DNA, 19 bp, Homo sapiens
tcatttatctgttgggaag

SEQ ID NO: 35707 - DNA, 20 bp, Homo sapiens
tcatttatctgttgggaagc

SEQ ID NO: 35708 - DNA, 21 bp, Homo sapiens
tcatttatctgttgggaagct

SEQ ID NO: 35709 - DNA, 23 bp, Homo sapiens
tcatttatctgttgggaagctaa

SEQ ID NO: 35710 - DNA, 24 bp, Homo sapiens
tcatttatctgttgggaagctaac

SEQ ID NO: 35711 - DNA, 22 bp, Homo sapiens
catttatctgttgggaagctaa

SEQ ID NO: 35712 - DNA, 23 bp, Homo sapiens
catttatctgttgggaagctaac

SEQ ID NO: 35713 - DNA, 21 bp, Homo sapiens
atctgttgggaagctaactgt

SEQ ID NO: 35714 - DNA, 18 bp, Homo sapiens
tagcttatcagactgatg

SEQ ID NO: 35715 - DNA, 20 bp, Homo sapiens
tagcttatcagactgatgtt

SEQ ID NO: 35716 - DNA, 21 bp, Homo sapiens
tagcttatcagactgatgttg

SEQ ID NO: 35717 - DNA, 23 bp, Homo sapiens
tagcttatcagactgatgttgac

SEQ ID NO: 35718 - DNA, 24 bp, Homo sapiens
tagcttatcagactgatgttgact

SEQ ID NO: 35719 - DNA, 22 bp, Homo sapiens
agcttatcagactgatgttgac

SEQ ID NO: 35720 - DNA, 18 bp, Homo sapiens
cttatcagactgatgttg

SEQ ID NO: 35721 - DNA, 19 bp, Homo sapiens
cttatcagactgatgttga

SEQ ID NO: 35722 - DNA, 20 bp, Homo sapiens
cttatcagactgatgttgac

SEQ ID NO: 35723 - DNA, 21 bp, Homo sapiens
cttatcagactgatgttgact

SEQ ID NO: 35724 - DNA, 22 bp, Homo sapiens
cttatcagactgatgttgactg

SEQ ID NO: 35725 - DNA, 25 bp, Homo sapiens
cttatcagactgatgttgactgttg

SEQ ID NO: 35726 - DNA, 22 bp, Homo sapiens
atggcaacaccagtcgatgggc

SEQ ID NO: 35727 - DNA, 16 bp, Homo sapiens
caacaccagtcgatgg

SEQ ID NO: 35728 - DNA, 17 bp, Homo sapiens
caacaccagtcgatggg

SEQ ID NO: 35729 - DNA, 19 bp, Homo sapiens
caacaccagtcgatgggct

SEQ ID NO: 35730 - DNA, 20 bp, Homo sapiens
caacaccagtcgatgggctg

SEQ ID NO: 35731 - DNA, 22 bp, Homo sapiens
caacaccagtcgatgggctgtc

SEQ ID NO: 35732 - DNA, 23 bp, Homo sapiens
caacaccagtcgatgggctgtct

SEQ ID NO: 35733 - DNA, 24 bp, Homo sapiens
caacaccagtcgatgggctgtctg

SEQ ID NO: 35734 - DNA, 22 bp, Homo sapiens
aacaccagtcgatgggctgtct

SEQ ID NO: 35735 - DNA, 22 bp, Homo sapiens
tgcgaggatgctgacagtgcct

SEQ ID NO: 35736 - DNA, 23 bp, Homo sapiens
atgcgaggatgctgacagtgcct

SEQ ID NO: 35737 - DNA, 22 bp, Homo sapiens
atgcgaggatgctgacagtgcc

SEQ ID NO: 35738 - DNA, 16 bp, Homo sapiens
gaaggctaatagtatc

SEQ ID NO: 35739 - DNA, 21 bp, Homo sapiens
gctaatagtatctaccacaat

SEQ ID NO: 35740 - DNA, 24 bp, Homo sapiens
ccacactgcaacaccttacagatg

SEQ ID NO: 35741 - DNA, 26 bp, Homo sapiens
tgccacactgcaacaccttacagatg

SEQ ID NO: 35742 - DNA, 27 bp, Homo sapiens
ttgccacactgcaacaccttacagatg

SEQ ID NO: 35743 - DNA, 22 bp, Homo sapiens
gccacactgcaacaccttacag

SEQ ID NO: 35744 - DNA, 24 bp, Homo sapiens
ttgccacactgcaacaccttacag

SEQ ID NO: 35745 - DNA, 22 bp, Homo sapiens
tgccacactgcaacaccttaca

SEQ ID NO: 35746 - DNA, 24 bp, Homo sapiens
tttgccacactgcaacaccttaca

SEQ ID NO: 35747 - DNA, 22 bp, Homo sapiens
ttgccacactgcaacaccttac

SEQ ID NO: 35748 - DNA, 23 bp, Homo sapiens
tttgccacactgcaacaccttac

SEQ ID NO: 35749 - DNA, 20 bp, Homo sapiens
tgccacactgcaacacctta

SEQ ID NO: 35750 - DNA, 21 bp, Homo sapiens
ttgccacactgcaacacctta

SEQ ID NO: 35751 - DNA, 22 bp, Homo sapiens
tttgccacactgcaacacctta

SEQ ID NO: 35752 - DNA, 21 bp, Homo sapiens
tttgccacactgcaacacctt

SEQ ID NO: 35753 - DNA, 20 bp, Homo sapiens
tttgccacactgcaacacct

SEQ ID NO: 35754 - DNA, 20 bp, Homo sapiens
ctattttgccacactgcaac

SEQ ID NO: 35755 - DNA, 21 bp, Homo sapiens
tgttgtggtgtgcaaaactcc

SEQ ID NO: 35756 - DNA, 22 bp, Homo sapiens
ctgttgtggtgtgcaaaactcc

SEQ ID NO: 35757 - DNA, 23 bp, Homo sapiens
gctgttgtggtgtgcaaaactcc

SEQ ID NO: 35758 - DNA, 27 bp, Homo sapiens
tctggctgttgtggtgtgcaaaactcc

SEQ ID NO: 35759 - DNA, 24 bp, Homo sapiens
tggctgttgtggtgtgcaaaactc

SEQ ID NO: 35760 - DNA, 26 bp, Homo sapiens
tctggctgttgtggtgtgcaaaactc

SEQ ID NO: 35761 - DNA, 22 bp, Homo sapiens
ggctgttgtggtgtgcaaaact

SEQ ID NO: 35762 - DNA, 23 bp, Homo sapiens
tggctgttgtggtgtgcaaaact

SEQ ID NO: 35763 - DNA, 26 bp, Homo sapiens
gtctggctgttgtggtgtgcaaaact

SEQ ID NO: 35764 - DNA, 28 bp, Homo sapiens
tggtctggctgttgtggtgtgcaaaact

SEQ ID NO: 35765 - DNA, 22 bp, Homo sapiens
tggctgttgtggtgtgcaaaac

SEQ ID NO: 35766 - DNA, 24 bp, Homo sapiens
tctggctgttgtggtgtgcaaaac

SEQ ID NO: 35767 - DNA, 21 bp, Homo sapiens
tggctgttgtggtgtgcaaaa

SEQ ID NO: 35768 - DNA, 23 bp, Homo sapiens
tctggctgttgtggtgtgcaaaa

SEQ ID NO: 35769 - DNA, 24 bp, Homo sapiens
gtctggctgttgtggtgtgcaaaa

SEQ ID NO: 35770 - DNA, 20 bp, Homo sapiens
tggctgttgtggtgtgcaaa

SEQ ID NO: 35771 - DNA, 22 bp, Homo sapiens
tctggctgttgtggtgtgcaaa

SEQ ID NO: 35772 - DNA, 23 bp, Homo sapiens
gtctggctgttgtggtgtgcaaa

SEQ ID NO: 35773 - DNA, 18 bp, Homo sapiens
ggctgttgtggtgtgcaa

SEQ ID NO: 35774 - DNA, 19 bp, Homo sapiens
tggctgttgtggtgtgcaa

SEQ ID NO: 35775 - DNA, 20 bp, Homo sapiens
ctggctgttgtggtgtgcaa

SEQ ID NO: 35776 - DNA, 20 bp, Homo sapiens
tctggctgttgtggtgtgca

SEQ ID NO: 35777 - DNA, 19 bp, Homo sapiens
tctggctgttgtggtgtgc

SEQ ID NO: 35778 - DNA, 21 bp, Homo sapiens
ctgcggttgtaaggtcttggc

SEQ ID NO: 35779 - DNA, 22 bp, Homo sapiens
gctgcggttgtaaggtcttggc

SEQ ID NO: 35780 - DNA, 23 bp, Homo sapiens
agctgcggttgtaaggtcttggc

SEQ ID NO: 35781 - DNA, 24 bp, Homo sapiens
tggacagaaaacacgcaggaagaa

SEQ ID NO: 35782 - DNA, 25 bp, Homo sapiens
ttggacagaaaacacgcaggaagaa

SEQ ID NO: 35783 - DNA, 20 bp, Homo sapiens
tcttcctgcgtgttttctgt

SEQ ID NO: 35784 - DNA, 23 bp, Homo sapiens
tggacagaaaacacgcaggaaga

SEQ ID NO: 35785 - DNA, 24 bp, Homo sapiens
ttggacagaaaacacgcaggaaga

SEQ ID NO: 35786 - DNA, 22 bp, Homo sapiens
tggacagaaaacacgcaggaag

SEQ ID NO: 35787 - DNA, 23 bp, Homo sapiens
ttggacagaaaacacgcaggaag

SEQ ID NO: 35788 - DNA, 24 bp, Homo sapiens
tttggacagaaaacacgcaggaag

SEQ ID NO: 35789 - DNA, 19 bp, Homo sapiens
ttcctgcgtgttttctgtc

SEQ ID NO: 35790 - DNA, 23 bp, Homo sapiens
tttggacagaaaacacgcaggaa

SEQ ID NO: 35791 - DNA, 21 bp, Homo sapiens
ttggacagaaaacacgcagga

SEQ ID NO: 35792 - DNA, 21 bp, Homo sapiens
tcctgcgtgttttctgtccaa

SEQ ID NO: 35793 - DNA, 22 bp, Homo sapiens
tttggacagaaaacacgcagga

SEQ ID NO: 35794 - DNA, 20 bp, Homo sapiens
cgtgttttctgtccaaatca

SEQ ID NO: 35795 - DNA, 25 bp, Homo sapiens
cacctgcgtgttttctgtccaaatc

SEQ ID NO: 35796 - DNA, 23 bp, Homo sapiens
acctgcgtgttttctgtccaaat

SEQ ID NO: 35797 - DNA, 23 bp, Homo sapiens
atttggacagaaaacacgcaggt

SEQ ID NO: 35798 - DNA, 25 bp, Homo sapiens
ccacctgcgtgttttctgtccaaat

SEQ ID NO: 35799 - DNA, 22 bp, Homo sapiens
acctgcgtgttttctgtccaaa

SEQ ID NO: 35800 - DNA, 23 bp, Homo sapiens
cacctgcgtgttttctgtccaaa

SEQ ID NO: 35801 - DNA, 23 bp, Homo sapiens
tttggacagaaaacacgcaggtg

SEQ ID NO: 35802 - DNA, 24 bp, Homo sapiens
tttggacagaaaacacgcaggtgg

SEQ ID NO: 35803 - DNA, 22 bp, Homo sapiens
ttggacagaaaacacgcaggtg

SEQ ID NO: 35804 - DNA, 23 bp, Homo sapiens
ttggacagaaaacacgcaggtgg

SEQ ID NO: 35805 - DNA, 20 bp, Homo sapiens
tggacagaaaacacgcaggt

SEQ ID NO: 35806 - DNA, 22 bp, Homo sapiens
tggacagaaaacacgcaggtgg

SEQ ID NO: 35807 - DNA, 21 bp, Homo sapiens
ccacctgcgtgttttctgtcc

SEQ ID NO: 35808 - DNA, 23 bp, Homo sapiens
gacagaaaacacgcaggtggcac

SEQ ID NO: 35809 - DNA, 19 bp, Homo sapiens
acttgggcactgaaacaat

SEQ ID NO: 35810 - DNA, 25 bp, Homo sapiens
agacaggcttatgctgctatccttc

SEQ ID NO: 35811 - DNA, 27 bp, Homo sapiens
tgagacaggcttatgctgctatccttc

SEQ ID NO: 35812 - DNA, 26 bp, Homo sapiens
tgagacaggcttatgctgctatcctt

SEQ ID NO: 35813 - DNA, 24 bp, Homo sapiens
aggatagcagcataagcctgtctc

SEQ ID NO: 35814 - DNA, 25 bp, Homo sapiens
tgagacaggcttatgctgctatcct

SEQ ID NO: 35815 - DNA, 22 bp, Homo sapiens
agacaggcttatgctgctatcc

SEQ ID NO: 35816 - DNA, 24 bp, Homo sapiens
tgagacaggcttatgctgctatcc

SEQ ID NO: 35817 - DNA, 21 bp, Homo sapiens
agacaggcttatgctgctatc

SEQ ID NO: 35818 - DNA, 23 bp, Homo sapiens
tgagacaggcttatgctgctatc

SEQ ID NO: 35819 - DNA, 20 bp, Homo sapiens
agacaggcttatgctgctat

SEQ ID NO: 35820 - DNA, 21 bp, Homo sapiens
gagacaggcttatgctgctat

SEQ ID NO: 35821 - DNA, 22 bp, Homo sapiens
atagcagcataagcctgtctca

SEQ ID NO: 35822 - DNA, 19 bp, Homo sapiens
agacaggcttatgctgcta

SEQ ID NO: 35823 - DNA, 21 bp, Homo sapiens
tgagacaggcttatgctgcta

SEQ ID NO: 35824 - DNA, 20 bp, Homo sapiens
tgagacaggcttatgctgct

SEQ ID NO: 35825 - DNA, 20 bp, Homo sapiens
agcagcataagcctgtctca

SEQ ID NO: 35826 - DNA, 19 bp, Homo sapiens
tgagacaggcttatgctgc

SEQ ID NO: 35827 - DNA, 18 bp, Homo sapiens
tgagacaggcttatgctg

SEQ ID NO: 35828 - DNA, 23 bp, Homo sapiens
agcagcatgaacctgtctcactg

SEQ ID NO: 35829 - DNA, 20 bp, Homo sapiens
cagcatgaacctgtctcact

SEQ ID NO: 35830 - DNA, 22 bp, Homo sapiens
agcagcatgaacctgtctcact

SEQ ID NO: 35831 - DNA, 21 bp, Homo sapiens
agcagcatgaacctgtctcac

SEQ ID NO: 35832 - DNA, 23 bp, Homo sapiens
atagcagcatgaacctgtctcac

SEQ ID NO: 35833 - DNA, 20 bp, Homo sapiens
agcagcatgaacctgtctca

SEQ ID NO: 35834 - DNA, 25 bp, Homo sapiens
aacgatagcagcatgaacctgtctc

SEQ ID NO: 35835 - DNA, 22 bp, Homo sapiens
agacaggttcatgctgctatcg

SEQ ID NO: 35836 - DNA, 23 bp, Homo sapiens
agacaggttcatgctgctatcgt

SEQ ID NO: 35837 - DNA, 17 bp, Homo sapiens
agcagcatgaacctgtc

SEQ ID NO: 35838 - DNA, 17 bp, Homo sapiens
ggaacgatagcagcatg

SEQ ID NO: 35839 - DNA, 26 bp, Homo sapiens
ccaatattggctgtgctgctccaggc

SEQ ID NO: 35840 - DNA, 25 bp, Homo sapiens
ccaatattggctgtgctgctccagg

SEQ ID NO: 35841 - DNA, 24 bp, Homo sapiens
ccaatattggctgtgctgctccag

SEQ ID NO: 35842 - DNA, 23 bp, Homo sapiens
ccaatattggctgtgctgctcca

SEQ ID NO: 35843 - DNA, 21 bp, Homo sapiens
ccaatattggctgtgctgctc

SEQ ID NO: 35844 - DNA, 20 bp, Homo sapiens
ccaatattggctgtgctgct

SEQ ID NO: 35845 - DNA, 19 bp, Homo sapiens
ccaatattggctgtgctgc

SEQ ID NO: 35846 - DNA, 18 bp, Homo sapiens
ccaatattggctgtgctg

SEQ ID NO: 35847 - DNA, 17 bp, Homo sapiens
ccaatattggctgtgct

SEQ ID NO: 35848 - DNA, 21 bp, Homo sapiens
cagcacagaaatattggcaca

SEQ ID NO: 35849 - DNA, 24 bp, Homo sapiens
tagcagcacagaaatattggcaca

SEQ ID NO: 35850 - DNA, 20 bp, Homo sapiens
cagcacagaaatattggcac

SEQ ID NO: 35851 - DNA, 23 bp, Homo sapiens
tagcagcacagaaatattggcac

SEQ ID NO: 35852 - DNA, 19 bp, Homo sapiens
cagcacagaaatattggca

SEQ ID NO: 35853 - DNA, 21 bp, Homo sapiens
agcagcacagaaatattggca

SEQ ID NO: 35854 - DNA, 22 bp, Homo sapiens
tagcagcacagaaatattggca

SEQ ID NO: 35855 - DNA, 18 bp, Homo sapiens
cagcacagaaatattggc

SEQ ID NO: 35856 - DNA, 19 bp, Homo sapiens
gcagcacagaaatattggc

SEQ ID NO: 35857 - DNA, 20 bp, Homo sapiens
tagcagcacagaaatattgg

SEQ ID NO: 35858 - DNA, 24 bp, Homo sapiens
caaaccacactgtggtgttagagc

SEQ ID NO: 35859 - DNA, 25 bp, Homo sapiens
ccaaaccacactgtggtgttagagc

SEQ ID NO: 35860 - DNA, 26 bp, Homo sapiens
tccaaaccacactgtggtgttagagc

SEQ ID NO: 35861 - DNA, 23 bp, Homo sapiens
caaaccacactgtggtgttagag

SEQ ID NO: 35862 - DNA, 23 bp, Homo sapiens
ccaaaccacactgtggtgttaga

SEQ ID NO: 35863 - DNA, 20 bp, Homo sapiens
aaaccacactgtggtgttag

SEQ ID NO: 35864 - DNA, 21 bp, Homo sapiens
caaaccacactgtggtgttag

SEQ ID NO: 35865 - DNA, 22 bp, Homo sapiens
ccaaaccacactgtggtgttag

SEQ ID NO: 35866 - DNA, 23 bp, Homo sapiens
tccaaaccacactgtggtgttag

SEQ ID NO: 35867 - DNA, 20 bp, Homo sapiens
caaaccacactgtggtgtta

SEQ ID NO: 35868 - DNA, 21 bp, Homo sapiens
ccaaaccacactgtggtgtta

SEQ ID NO: 35869 - DNA, 22 bp, Homo sapiens
tccaaaccacactgtggtgtta

SEQ ID NO: 35870 - DNA, 19 bp, Homo sapiens
caaaccacactgtggtgtt

SEQ ID NO: 35871 - DNA, 20 bp, Homo sapiens
tccaaaccacactgtggtgt

SEQ ID NO: 35872 - DNA, 17 bp, Homo sapiens
caaaccacactgtggtg

SEQ ID NO: 35873 - DNA, 22 bp, Homo sapiens
agcagcacactgtggtttgtac

SEQ ID NO: 35874 - DNA, 23 bp, Homo sapiens
cagcagcacactgtggtttgtac

SEQ ID NO: 35875 - DNA, 21 bp, Homo sapiens
agcagcacactgtggtttgta

SEQ ID NO: 35876 - DNA, 22 bp, Homo sapiens
cagcagcacactgtggtttgta

SEQ ID NO: 35877 - DNA, 20 bp, Homo sapiens
agcagcacactgtggtttgt

SEQ ID NO: 35878 - DNA, 20 bp, Homo sapiens
cagcagcacactgtggtttg

SEQ ID NO: 35879 - DNA, 19 bp, Homo sapiens
cagcagcacactgtggttt

SEQ ID NO: 35880 - DNA, 18 bp, Homo sapiens
cagcagcacactgtggtt

SEQ ID NO: 35881 - DNA, 24 bp, Homo sapiens
actgccccaggtgctgctgggggt

SEQ ID NO: 35882 - DNA, 26 bp, Homo sapiens
ccactgccccaggtgctgctgggggt

SEQ ID NO: 35883 - DNA, 23 bp, Homo sapiens
actgccccaggtgctgctggggg

SEQ ID NO: 35884 - DNA, 25 bp, Homo sapiens
ccactgccccaggtgctgctggggg

SEQ ID NO: 35885 - DNA, 22 bp, Homo sapiens
actgccccaggtgctgctgggg

SEQ ID NO: 35886 - DNA, 24 bp, Homo sapiens
ccactgccccaggtgctgctgggg

SEQ ID NO: 35887 - DNA, 21 bp, Homo sapiens
actgccccaggtgctgctggg

SEQ ID NO: 35888 - DNA, 23 bp, Homo sapiens
ccactgccccaggtgctgctggg

SEQ ID NO: 35889 - DNA, 22 bp, Homo sapiens
ccactgccccaggtgctgctgg

SEQ ID NO: 35890 - DNA, 19 bp, Homo sapiens
actgccccaggtgctgctg

SEQ ID NO: 35891 - DNA, 21 bp, Homo sapiens
ccactgccccaggtgctgctg

SEQ ID NO: 35892 - DNA, 20 bp, Homo sapiens
ccactgccccaggtgctgct

SEQ ID NO: 35893 - DNA, 19 bp, Homo sapiens
ccactgccccaggtgctgc

SEQ ID NO: 35894 - DNA, 18 bp, Homo sapiens
ccactgccccaggtgctg

SEQ ID NO: 35895 - DNA, 27 bp, Homo sapiens
cgcatcccctagggcattggtgtaaag

SEQ ID NO: 35896 - DNA, 25 bp, Homo sapiens
cgcatcccctagggcattggtgtaa

SEQ ID NO: 35897 - DNA, 24 bp, Homo sapiens
cgcatcccctagggcattggtgta

SEQ ID NO: 35898 - DNA, 22 bp, Homo sapiens
gcatcccctagggcattggtgt

SEQ ID NO: 35899 - DNA, 22 bp, Homo sapiens
cgcatcccctagggcattggtg

SEQ ID NO: 35900 - DNA, 21 bp, Homo sapiens
cgcatcccctagggcattggt

SEQ ID NO: 35901 - DNA, 20 bp, Homo sapiens
cgcatcccctagggcattgg

SEQ ID NO: 35902 - DNA, 19 bp, Homo sapiens
cgcatcccctagggcattg

SEQ ID NO: 35903 - DNA, 18 bp, Homo sapiens
cgcatcccctagggcatt

SEQ ID NO: 35904 - DNA, 17 bp, Homo sapiens
tctctcggctcctcgcg

SEQ ID NO: 35905 - DNA, 18 bp, Homo sapiens
tctctcggctcctcgcgg

SEQ ID NO: 35906 - DNA, 19 bp, Homo sapiens
tctctcggctcctcgcggc

SEQ ID NO: 35907 - DNA, 20 bp, Homo sapiens
tctctcggctcctcgcggct

SEQ ID NO: 35908 - DNA, 22 bp, Homo sapiens
tctctcggctcctcgcggctcg

SEQ ID NO: 35909 - DNA, 23 bp, Homo sapiens
tctctcggctcctcgcggctcgc

SEQ ID NO: 35910 - DNA, 24 bp, Homo sapiens
tctctcggctcctcgcggctcgcg

SEQ ID NO: 35911 - DNA, 25 bp, Homo sapiens
tctctcggctcctcgcggctcgcgg

SEQ ID NO: 35912 - DNA, 21 bp, Homo sapiens
ctctcggctcctcgcggctcg

SEQ ID NO: 35913 - DNA, 18 bp, Homo sapiens
atccggtccgtacaaact

SEQ ID NO: 35914 - DNA, 21 bp, Homo sapiens
atccggtccgtacaaactctg

SEQ ID NO: 35915 - DNA, 22 bp, Homo sapiens
tccggtccgtacaaactctgct

SEQ ID NO: 35916 - DNA, 23 bp, Homo sapiens
tccggtccgtacaaactctgctg

SEQ ID NO: 35917 - DNA, 27 bp, Homo sapiens
tccggtccgtacaaactctgctgtgtt

SEQ ID NO: 35918 - DNA, 21 bp, Homo sapiens
tccgtacaaactctgctgtgt

SEQ ID NO: 35919 - DNA, 22 bp, Homo sapiens
tccgtacaaactctgctgtgtt

SEQ ID NO: 35920 - DNA, 18 bp, Homo sapiens
ctgcagagtttgtacgga

SEQ ID NO: 35921 - DNA, 21 bp, Homo sapiens
ctgcagagtttgtacggaccg

SEQ ID NO: 35922 - DNA, 23 bp, Homo sapiens
ctgcagagtttgtacggaccgga

SEQ ID NO: 35923 - DNA, 25 bp, Homo sapiens
ctgcagagtttgtacggaccggatt

SEQ ID NO: 35924 - DNA, 20 bp, Homo sapiens
tgcagagtttgtacggaccg

SEQ ID NO: 35925 - DNA, 22 bp, Homo sapiens
tgcagagtttgtacggaccgga

SEQ ID NO: 35926 - DNA, 23 bp, Homo sapiens
tgcagagtttgtacggaccggat

SEQ ID NO: 35927 - DNA, 25 bp, Homo sapiens
tgcagagtttgtacggaccggattc

SEQ ID NO: 35928 - DNA, 20 bp, Homo sapiens
cctgggagggcgtggatgat

SEQ ID NO: 35929 - DNA, 23 bp, Homo sapiens
cctgggagggcgtggatgatggt

SEQ ID NO: 35930 - DNA, 25 bp, Homo sapiens
cctgggagggcgtggatgatggtgg

SEQ ID NO: 35931 - DNA, 18 bp, Homo sapiens
ctgggagggcgtggatga

SEQ ID NO: 35932 - DNA, 20 bp, Homo sapiens
ctgggagggcgtggatgatg

SEQ ID NO: 35933 - DNA, 22 bp, Homo sapiens
ctgggagggcgtggatgatggt

SEQ ID NO: 35934 - DNA, 23 bp, Homo sapiens
ctgggagggcgtggatgatggtg

SEQ ID NO: 35935 - DNA, 24 bp, Homo sapiens
ctgggagggcgtggatgatggtgg

SEQ ID NO: 35936 - DNA, 19 bp, Homo sapiens
tgggagggcgtggatgatg

SEQ ID NO: 35937 - DNA, 20 bp, Homo sapiens
tgggagggcgtggatgatgg

SEQ ID NO: 35938 - DNA, 21 bp, Homo sapiens
tgggagggcgtggatgatggt

SEQ ID NO: 35939 - DNA, 23 bp, Homo sapiens
tgggagggcgtggatgatggtgg

SEQ ID NO: 35940 - DNA, 25 bp, Homo sapiens
tgggagggcgtggatgatggtggga

SEQ ID NO: 35941 - DNA, 26 bp, Homo sapiens
tgggagggcgtggatgatggtgggag

SEQ ID NO: 35942 - DNA, 17 bp, Homo sapiens
cacatcgccccaccttc

SEQ ID NO: 35943 - DNA, 21 bp, Homo sapiens
cacatcgccccaccttcccca

SEQ ID NO: 35944 - DNA, 22 bp, Homo sapiens
cacatcgccccaccttccccag

SEQ ID NO: 35945 - DNA, 23 bp, Homo sapiens
cacatcgccccaccttccccagt

SEQ ID NO: 35946 - DNA, 24 bp, Homo sapiens
cacatcgccccaccttccccagtc

SEQ ID NO: 35947 - DNA, 20 bp, Homo sapiens
acatcgccccaccttcccca

SEQ ID NO: 35948 - DNA, 22 bp, Homo sapiens
acatcgccccaccttccccagt

SEQ ID NO: 35949 - DNA, 24 bp, Homo sapiens
acatcgccccaccttccccagtct

SEQ ID NO: 35950 - DNA, 16 bp, Homo sapiens
gcctggaggagaaggg

SEQ ID NO: 35951 - DNA, 17 bp, Homo sapiens
cgcctggaggagaaggg

SEQ ID NO: 35952 - DNA, 18 bp, Homo sapiens
gcgcctggaggagaaggg

SEQ ID NO: 35953 - DNA, 24 bp, Homo sapiens
gaaactggagcgcctggaggagaa

SEQ ID NO: 35954 - DNA, 21 bp, Homo sapiens
aactggagcgcctggaggaga

SEQ ID NO: 35955 - DNA, 22 bp, Homo sapiens
aaactggagcgcctggaggaga

SEQ ID NO: 35956 - DNA, 23 bp, Homo sapiens
gaaactggagcgcctggaggaga

SEQ ID NO: 35957 - DNA, 24 bp, Homo sapiens
tgaaactggagcgcctggaggaga

SEQ ID NO: 35958 - DNA, 19 bp, Homo sapiens
actggagcgcctggaggag

SEQ ID NO: 35959 - DNA, 21 bp, Homo sapiens
aaactggagcgcctggaggag

SEQ ID NO: 35960 - DNA, 22 bp, Homo sapiens
gaaactggagcgcctggaggag

SEQ ID NO: 35961 - DNA, 23 bp, Homo sapiens
tgaaactggagcgcctggaggag

SEQ ID NO: 35962 - DNA, 24 bp, Homo sapiens
atgaaactggagcgcctggaggag

SEQ ID NO: 35963 - DNA, 20 bp, Homo sapiens
aaactggagcgcctggagga

SEQ ID NO: 35964 - DNA, 21 bp, Homo sapiens
gaaactggagcgcctggagga

SEQ ID NO: 35965 - DNA, 19 bp, Homo sapiens
aaactggagcgcctggagg

SEQ ID NO: 35966 - DNA, 20 bp, Homo sapiens
gaaactggagcgcctggagg

SEQ ID NO: 35967 - DNA, 21 bp, Homo sapiens
tgaaactggagcgcctggagg

SEQ ID NO: 35968 - DNA, 22 bp, Homo sapiens
atgaaactggagcgcctggagg

SEQ ID NO: 35969 - DNA, 20 bp, Homo sapiens
tgaaactggagcgcctggag

SEQ ID NO: 35970 - DNA, 21 bp, Homo sapiens
atgaaactggagcgcctggag

SEQ ID NO: 35971 - DNA, 22 bp, Homo sapiens
catgaaactggagcgcctggag

SEQ ID NO: 35972 - DNA, 23 bp, Homo sapiens
tttccatgaaactggagcgcctg

SEQ ID NO: 35973 - DNA, 21 bp, Homo sapiens
tttccatgaaactggagcgcc

SEQ ID NO: 35974 - DNA, 19 bp, Homo sapiens
tttccatgaaactggagcg

SEQ ID NO: 35975 - DNA, 18 bp, Homo sapiens
tttccatgaaactggagc

SEQ ID NO: 35976 - DNA, 17 bp, Homo sapiens
tttccatgaaactggag

SEQ ID NO: 35977 - DNA, 16 bp, Homo sapiens
tcagtttcatagggaa

SEQ ID NO: 35978 - DNA, 17 bp, Homo sapiens
ttcagtttcatagggaa

SEQ ID NO: 35979 - DNA, 18 bp, Homo sapiens
tttcagtttcatagggaa

SEQ ID NO: 35980 - DNA, 21 bp, Homo sapiens
gcgcgttttcagtttcatagg

SEQ ID NO: 35981 - DNA, 25 bp, Homo sapiens
accagcgcgttttcagtttcatagg

SEQ ID NO: 35982 - DNA, 23 bp, Homo sapiens
accagcgcgttttcagtttcata

SEQ ID NO: 35983 - DNA, 21 bp, Homo sapiens
accagcgcgttttcagtttca

SEQ ID NO: 35984 - DNA, 25 bp, Homo sapiens
ttccttctgttgtctgtgcagaaac

SEQ ID NO: 35985 - DNA, 24 bp, Homo sapiens
ttccttctgttgtctgtgcagaaa

SEQ ID NO: 35986 - DNA, 23 bp, Homo sapiens
ttccttctgttgtctgtgcagaa

SEQ ID NO: 35987 - DNA, 21 bp, Homo sapiens
tccttctgttgtctgtgcaga

SEQ ID NO: 35988 - DNA, 22 bp, Homo sapiens
ttccttctgttgtctgtgcaga

SEQ ID NO: 35989 - DNA, 23 bp, Homo sapiens
cttccttctgttgtctgtgcaga

SEQ ID NO: 35990 - DNA, 22 bp, Homo sapiens
cttccttctgttgtctgtgcag

SEQ ID NO: 35991 - DNA, 20 bp, Homo sapiens
ttccttctgttgtctgtgca

SEQ ID NO: 35992 - DNA, 21 bp, Homo sapiens
cttccttctgttgtctgtgca

SEQ ID NO: 35993 - DNA, 20 bp, Homo sapiens
aacactgaagcagcaggcac

SEQ ID NO: 35994 - DNA, 21 bp, Homo sapiens
gaacactgaagcagcaggcac

SEQ ID NO: 35995 - DNA, 23 bp, Homo sapiens
cagaacactgaagcagcaggcac

SEQ ID NO: 35996 - DNA, 21 bp, Homo sapiens
cagaacactgaagcagcaggc

SEQ ID NO: 35997 - DNA, 20 bp, Homo sapiens
ggcagaacactgaagcagca

SEQ ID NO: 35998 - DNA, 26 bp, Homo sapiens
tgcttgctcgtcccgcccgcagccct

SEQ ID NO: 35999 - DNA, 23 bp, Homo sapiens
gcttgctcgtcccgcccgcagcc

SEQ ID NO: 36000 - DNA, 25 bp, Homo sapiens
tgtgcttgctcgtcccgcccgcagc

SEQ ID NO: 36001 - DNA, 26 bp, Homo sapiens
ctgtgcttgctcgtcccgcccgcagc

SEQ ID NO: 36002 - DNA, 20 bp, Homo sapiens
cttgctcgtcccgcccgcag

SEQ ID NO: 36003 - DNA, 24 bp, Homo sapiens
tgtgcttgctcgtcccgcccgcag

SEQ ID NO: 36004 - DNA, 25 bp, Homo sapiens
ctgtgcttgctcgtcccgcccgcag

SEQ ID NO: 36005 - DNA, 24 bp, Homo sapiens
ctgtgcttgctcgtcccgcccgca

SEQ ID NO: 36006 - DNA, 21 bp, Homo sapiens
gtgcttgctcgtcccgcccgc

SEQ ID NO: 36007 - DNA, 22 bp, Homo sapiens
tgtgcttgctcgtcccgcccgc

SEQ ID NO: 36008 - DNA, 23 bp, Homo sapiens
ctgtgcttgctcgtcccgcccgc

SEQ ID NO: 36009 - DNA, 21 bp, Homo sapiens
tgtgcttgctcgtcccgcccg

SEQ ID NO: 36010 - DNA, 20 bp, Homo sapiens
tgtgcttgctcgtcccgccc

SEQ ID NO: 36011 - DNA, 19 bp, Homo sapiens
tgtgcttgctcgtcccgcc

SEQ ID NO: 36012 - DNA, 24 bp, Homo sapiens
tttgaatttgcagtaacaggtgtg

SEQ ID NO: 36013 - DNA, 21 bp, Homo sapiens
atttgcagtaacaggtgtgag

SEQ ID NO: 36014 - DNA, 22 bp, Homo sapiens
atttgcagtaacaggtgtgagc

SEQ ID NO: 36015 - DNA, 23 bp, Homo sapiens
atttgcagtaacaggtgtgagca

SEQ ID NO: 36016 - DNA, 25 bp, Homo sapiens
atttgcagtaacaggtgtgagcatt

SEQ ID NO: 36017 - DNA, 27 bp, Homo sapiens
atttgcagtaacaggtgtgagcattct

SEQ ID NO: 36018 - DNA, 20 bp, Homo sapiens
tttgcagtaacaggtgtgag

SEQ ID NO: 36019 - DNA, 21 bp, Homo sapiens
tttgcagtaacaggtgtgagc

SEQ ID NO: 36020 - DNA, 23 bp, Homo sapiens
tttgcagtaacaggtgtgagcat

SEQ ID NO: 36021 - DNA, 24 bp, Homo sapiens
tttgcagtaacaggtgtgagcatt

SEQ ID NO: 36022 - DNA, 25 bp, Homo sapiens
tttgcagtaacaggtgtgagcattc

SEQ ID NO: 36023 - DNA, 26 bp, Homo sapiens
tttgcagtaacaggtgtgagcattct

SEQ ID NO: 36024 - DNA, 27 bp, Homo sapiens
tttgcagtaacaggtgtgagcattcta

SEQ ID NO: 36025 - DNA, 20 bp, Homo sapiens
ttgcagtaacaggtgtgagc

SEQ ID NO: 36026 - DNA, 22 bp, Homo sapiens
ttgcagtaacaggtgtgagcat

SEQ ID NO: 36027 - DNA, 23 bp, Homo sapiens
ttgcagtaacaggtgtgagcatt

SEQ ID NO: 36028 - DNA, 24 bp, Homo sapiens
ttgcagtaacaggtgtgagcattc

SEQ ID NO: 36029 - DNA, 21 bp, Homo sapiens
tgcagtaacaggtgtgagcat

SEQ ID NO: 36030 - DNA, 21 bp, Homo sapiens
agtaacaggtgtgagcattct

SEQ ID NO: 36031 - DNA, 19 bp, Homo sapiens
ttgatgatcatgtatgata

SEQ ID NO: 36032 - DNA, 20 bp, Homo sapiens
ttgatgatcatgtatgatac

SEQ ID NO: 36033 - DNA, 21 bp, Homo sapiens
ttgatgatcatgtatgatact

SEQ ID NO: 36034 - DNA, 22 bp, Homo sapiens
ttgatgatcatgtatgatactg

SEQ ID NO: 36035 - DNA, 24 bp, Homo sapiens
ttgatgatcatgtatgatactgca

SEQ ID NO: 36036 - DNA, 19 bp, Homo sapiens
atgatcatgtatgatactg

SEQ ID NO: 36037 - DNA, 28 bp, Homo sapiens
atgatcatgtatgatactgcaaacagga

SEQ ID NO: 36038 - DNA, 20 bp, Homo sapiens
tgatcatgtatgatactgca

SEQ ID NO: 36039 - DNA, 21 bp, Homo sapiens
tgatcatgtatgatactgcaa

SEQ ID NO: 36040 - DNA, 23 bp, Homo sapiens
tgatcatgtatgatactgcaaac

SEQ ID NO: 36041 - DNA, 24 bp, Homo sapiens
tgatcatgtatgatactgcaaaca

SEQ ID NO: 36042 - DNA, 27 bp, Homo sapiens
tgatcatgtatgatactgcaaacagga

SEQ ID NO: 36043 - DNA, 26 bp, Homo sapiens
gatcatgtatgatactgcaaacagga

SEQ ID NO: 36044 - DNA, 19 bp, Homo sapiens
atcatgtatgatactgcaa

SEQ ID NO: 36045 - DNA, 21 bp, Homo sapiens
atcatgtatgatactgcaaac

SEQ ID NO: 36046 - DNA, 23 bp, Homo sapiens
atcatgtatgatactgcaaacag

SEQ ID NO: 36047 - DNA, 24 bp, Homo sapiens
atcatgtatgatactgcaaacagg

SEQ ID NO: 36048 - DNA, 25 bp, Homo sapiens
atcatgtatgatactgcaaacagga

SEQ ID NO: 36049 - DNA, 22 bp, Homo sapiens
tcatgtatgatactgcaaacag

SEQ ID NO: 36050 - DNA, 24 bp, Homo sapiens
tcatgtatgatactgcaaacagga

SEQ ID NO: 36051 - DNA, 26 bp, Homo sapiens
tcatgtatgatactgcaaacaggacc

SEQ ID NO: 36052 - DNA, 16 bp, Homo sapiens
catgtatgatactgca

SEQ ID NO: 36053 - DNA, 21 bp, Homo sapiens
catgtatgatactgcaaacag

SEQ ID NO: 36054 - DNA, 23 bp, Homo sapiens
catgtatgatactgcaaacagga

SEQ ID NO: 36055 - DNA, 25 bp, Homo sapiens
catgtatgatactgcaaacaggacc

SEQ ID NO: 36056 - DNA, 20 bp, Homo sapiens
atgtatgatactgcaaacag

SEQ ID NO: 36057 - DNA, 22 bp, Homo sapiens
atgtatgatactgcaaacagga

SEQ ID NO: 36058 - DNA, 24 bp, Homo sapiens
atgtatgatactgcaaacaggacc

SEQ ID NO: 36059 - DNA, 23 bp, Homo sapiens
tgtatgatactgcaaacaggacc

SEQ ID NO: 36060 - DNA, 20 bp, Homo sapiens
gtatgatactgcaaacagga

SEQ ID NO: 36061 - DNA, 19 bp, Homo sapiens
tatgatactgcaaacagga

SEQ ID NO: 36062 - DNA, 18 bp, Homo sapiens
atgatactgcaaacagga

SEQ ID NO: 36063 - DNA, 16 bp, Homo sapiens
ttgttctcaaactggc

SEQ ID NO: 36064 - DNA, 17 bp, Homo sapiens
ttgttctcaaactggct

SEQ ID NO: 36065 - DNA, 21 bp, Homo sapiens
ttgttctcaaactggctgtca

SEQ ID NO: 36066 - DNA, 21 bp, Homo sapiens
tgttctcaaactggctgtcag

SEQ ID NO: 36067 - DNA, 22 bp, Homo sapiens
tgcagccacttggggaactggt

SEQ ID NO: 36068 - DNA, 23 bp, Homo sapiens
tgcagccacttggggaactggtt

SEQ ID NO: 36069 - DNA, 21 bp, Homo sapiens
agccacttggggaactggttc

SEQ ID NO: 36070 - DNA, 18 bp, Homo sapiens
tggggaactggttctgtg

SEQ ID NO: 36071 - DNA, 21 bp, Homo sapiens
tgaggctagctggtgtggtca

SEQ ID NO: 36072 - DNA, 22 bp, Homo sapiens
cccagggtgaggctagctggtg

SEQ ID NO: 36073 - DNA, 24 bp, Homo sapiens
agggaggaggagcggaggggccct

SEQ ID NO: 36074 - DNA, 24 bp, Homo sapiens
aagggaggaggagcggaggggccc

SEQ ID NO: 36075 - DNA, 23 bp, Homo sapiens
aagggaggaggagcggaggggcc

SEQ ID NO: 36076 - DNA, 22 bp, Homo sapiens
aagggaggaggagcggaggggc

SEQ ID NO: 36077 - DNA, 21 bp, Homo sapiens
aagggaggaggagcggagggg

SEQ ID NO: 36078 - DNA, 20 bp, Homo sapiens
aagggaggaggagcggaggg

SEQ ID NO: 36079 - DNA, 19 bp, Homo sapiens
aagggaggaggagcggagg

SEQ ID NO: 36080 - DNA, 18 bp, Homo sapiens
aagggaggaggagcggag

SEQ ID NO: 36081 - DNA, 22 bp, Homo sapiens
cccgggcgtggtggtgggggtg

SEQ ID NO: 36082 - DNA, 22 bp, Homo sapiens
ccgggcgtggtggtgggggtgg

SEQ ID NO: 36083 - DNA, 27 bp, Homo sapiens
ccgggcgtggtggtgggggtgggtgcc

SEQ ID NO: 36084 - DNA, 21 bp, Homo sapiens
cgggcgtggtggtgggggtgg

SEQ ID NO: 36085 - DNA, 22 bp, Homo sapiens
cgggcgtggtggtgggggtggg

SEQ ID NO: 36086 - DNA, 23 bp, Homo sapiens
cgggcgtggtggtgggggtgggt

SEQ ID NO: 36087 - DNA, 24 bp, Homo sapiens
cgggcgtggtggtgggggtgggtg

SEQ ID NO: 36088 - DNA, 26 bp, Homo sapiens
cgggcgtggtggtgggggtgggtgcc

SEQ ID NO: 36089 - DNA, 20 bp, Homo sapiens
gggcgtggtggtgggggtgg

SEQ ID NO: 36090 - DNA, 25 bp, Homo sapiens
gggcgtggtggtgggggtgggtgcc

SEQ ID NO: 36091 - DNA, 17 bp, Homo sapiens
ctggcggagcccattcc

SEQ ID NO: 36092 - DNA, 19 bp, Homo sapiens
ctggcggagcccattccat

SEQ ID NO: 36093 - DNA, 20 bp, Homo sapiens
ctggcggagcccattccatg

SEQ ID NO: 36094 - DNA, 21 bp, Homo sapiens
ctggcggagcccattccatgc

SEQ ID NO: 36095 - DNA, 22 bp, Homo sapiens
ctggcggagcccattccatgcc

SEQ ID NO: 36096 - DNA, 23 bp, Homo sapiens
tggcggagcccattccatgccag

SEQ ID NO: 36097 - DNA, 20 bp, Homo sapiens
ggcggagcccattccatgcc

SEQ ID NO: 36098 - DNA, 24 bp, Homo sapiens
gcaggttctcaccctctctaggcc

SEQ ID NO: 36099 - DNA, 23 bp, Homo sapiens
gcaggttctcaccctctctaggc

SEQ ID NO: 36100 - DNA, 22 bp, Homo sapiens
gcaggttctcaccctctctagg

SEQ ID NO: 36101 - DNA, 21 bp, Homo sapiens
gcaggttctcaccctctctag

SEQ ID NO: 36102 - DNA, 22 bp, Homo sapiens
ggcaggttctcaccctctctag

SEQ ID NO: 36103 - DNA, 20 bp, Homo sapiens
gcaggttctcaccctctcta

SEQ ID NO: 36104 - DNA, 19 bp, Homo sapiens
gcaggttctcaccctctct

SEQ ID NO: 36105 - DNA, 20 bp, Homo sapiens
ggcaggttctcaccctctct

SEQ ID NO: 36106 - DNA, 25 bp, Homo sapiens
tccagcatcagtgattttgttgaag

SEQ ID NO: 36107 - DNA, 24 bp, Homo sapiens
tccagcatcagtgattttgttgaa

SEQ ID NO: 36108 - DNA, 18 bp, Homo sapiens
tcaacaaaatcactgatg

SEQ ID NO: 36109 - DNA, 19 bp, Homo sapiens
tcaacaaaatcactgatgc

SEQ ID NO: 36110 - DNA, 20 bp, Homo sapiens
tcaacaaaatcactgatgct

SEQ ID NO: 36111 - DNA, 21 bp, Homo sapiens
tcaacaaaatcactgatgctg

SEQ ID NO: 36112 - DNA, 22 bp, Homo sapiens
ccagcatcagtgattttgttga

SEQ ID NO: 36113 - DNA, 22 bp, Homo sapiens
tcaacaaaatcactgatgctgg

SEQ ID NO: 36114 - DNA, 23 bp, Homo sapiens
tccagcatcagtgattttgttga

SEQ ID NO: 36115 - DNA, 24 bp, Homo sapiens
tcaacaaaatcactgatgctggag

SEQ ID NO: 36116 - DNA, 25 bp, Homo sapiens
tcaacaaaatcactgatgctggagt

SEQ ID NO: 36117 - DNA, 26 bp, Homo sapiens
tcaacaaaatcactgatgctggagtc

SEQ ID NO: 36118 - DNA, 24 bp, Homo sapiens
caacaaaatcactgatgctggagt

SEQ ID NO: 36119 - DNA, 21 bp, Homo sapiens
tccagcatcagtgattttgtt

SEQ ID NO: 36120 - DNA, 24 bp, Homo sapiens
aacaaaatcactgatgctggagtc

SEQ ID NO: 36121 - DNA, 20 bp, Homo sapiens
tccagcatcagtgattttgt

SEQ ID NO: 36122 - DNA, 18 bp, Homo sapiens
tccagcatcagtgatttt

SEQ ID NO: 36123 - DNA, 25 bp, Homo sapiens
aacaatatcctggtgctgagtgatg

SEQ ID NO: 36124 - DNA, 23 bp, Homo sapiens
aacaatatcctggtgctgagtga

SEQ ID NO: 36125 - DNA, 21 bp, Homo sapiens
acaatatcctggtgctgagtg

SEQ ID NO: 36126 - DNA, 21 bp, Homo sapiens
aacaatatcctggtgctgagt

SEQ ID NO: 36127 - DNA, 23 bp, Homo sapiens
ccaacaatatcctggtgctgagt

SEQ ID NO: 36128 - DNA, 20 bp, Homo sapiens
aacaatatcctggtgctgag

SEQ ID NO: 36129 - DNA, 18 bp, Homo sapiens
tcagcaccaggatattgt

SEQ ID NO: 36130 - DNA, 19 bp, Homo sapiens
aacaatatcctggtgctga

SEQ ID NO: 36131 - DNA, 19 bp, Homo sapiens
tcagcaccaggatattgtt

SEQ ID NO: 36132 - DNA, 20 bp, Homo sapiens
tcagcaccaggatattgttg

SEQ ID NO: 36133 - DNA, 21 bp, Homo sapiens
ccaacaatatcctggtgctga

SEQ ID NO: 36134 - DNA, 21 bp, Homo sapiens
tcagcaccaggatattgttgg

SEQ ID NO: 36135 - DNA, 22 bp, Homo sapiens
tcagcaccaggatattgttgga

SEQ ID NO: 36136 - DNA, 24 bp, Homo sapiens
tcagcaccaggatattgttggaga

SEQ ID NO: 36137 - DNA, 25 bp, Homo sapiens
tcagcaccaggatattgttggagag

SEQ ID NO: 36138 - DNA, 18 bp, Homo sapiens
aacaatatcctggtgctg

SEQ ID NO: 36139 - DNA, 22 bp, Homo sapiens
cagcaccaggatattgttggag

SEQ ID NO: 36140 - DNA, 22 bp, Homo sapiens
agcaccaggatattgttggaga

SEQ ID NO: 36141 - DNA, 26 bp, Homo sapiens
aggccacattttccagcccattcaac

SEQ ID NO: 36142 - DNA, 24 bp, Homo sapiens
aggccacattttccagcccattca

SEQ ID NO: 36143 - DNA, 23 bp, Homo sapiens
aggccacattttccagcccattc

SEQ ID NO: 36144 - DNA, 22 bp, Homo sapiens
aggccacattttccagcccatt

SEQ ID NO: 36145 - DNA, 21 bp, Homo sapiens
aggccacattttccagcccat

SEQ ID NO: 36146 - DNA, 24 bp, Homo sapiens
acggtgctggatgtggcctttttg

SEQ ID NO: 36147 - DNA, 23 bp, Homo sapiens
acggtgctggatgtggccttttt

SEQ ID NO: 36148 - DNA, 22 bp, Homo sapiens
acggtgctggatgtggcctttt

SEQ ID NO: 36149 - DNA, 20 bp, Homo sapiens
acggtgctggatgtggcctt

SEQ ID NO: 36150 - DNA, 18 bp, Homo sapiens
acggtgctggatgtggcc

SEQ ID NO: 36151 - DNA, 16 bp, Homo sapiens
acggtgctggatgtgg

SEQ ID NO: 36152 - DNA, 21 bp, Homo sapiens
cccgagaggatccgtccctgc

SEQ ID NO: 36153 - DNA, 21 bp, Homo sapiens
gcccgagaggatccgtccctg

SEQ ID NO: 36154 - DNA, 26 bp, Homo sapiens
aaggactgatcctctcgggcagggag

SEQ ID NO: 36155 - DNA, 22 bp, Homo sapiens
ggactgatcctctcgggcaggg

SEQ ID NO: 36156 - DNA, 23 bp, Homo sapiens
aaggactgatcctctcgggcagg

SEQ ID NO: 36157 - DNA, 21 bp, Homo sapiens
aggactgatcctctcgggcag

SEQ ID NO: 36158 - DNA, 22 bp, Homo sapiens
aaggactgatcctctcgggcag

SEQ ID NO: 36159 - DNA, 23 bp, Homo sapiens
caaggactgatcctctcgggcag

SEQ ID NO: 36160 - DNA, 21 bp, Homo sapiens
aaggactgatcctctcgggca

SEQ ID NO: 36161 - DNA, 23 bp, Homo sapiens
ccaaggactgatcctctcgggca

SEQ ID NO: 36162 - DNA, 21 bp, Homo sapiens
caaggactgatcctctcgggc

SEQ ID NO: 36163 - DNA, 23 bp, Homo sapiens
tgccaaggactgatcctctcggg

SEQ ID NO: 36164 - DNA, 20 bp, Homo sapiens
ctgccaaggactgatcctct

SEQ ID NO: 36165 - DNA, 16 bp, Homo sapiens
gatggctttggaacca

SEQ ID NO: 36166 - DNA, 23 bp, Homo sapiens
tcacgcggagagatggctttgga

SEQ ID NO: 36167 - DNA, 22 bp, Homo sapiens
tcacgcggagagatggctttgg

SEQ ID NO: 36168 - DNA, 19 bp, Homo sapiens
tcacgcggagagatggctt

SEQ ID NO: 36169 - DNA, 23 bp, Homo sapiens
caggcgtctgtctacgtggcttc

SEQ ID NO: 36170 - DNA, 24 bp, Homo sapiens
acaggcgtctgtctacgtggcttc

SEQ ID NO: 36171 - DNA, 21 bp, Homo sapiens
caggcgtctgtctacgtggct

SEQ ID NO: 36172 - DNA, 22 bp, Homo sapiens
acaggcgtctgtctacgtggct

SEQ ID NO: 36173 - DNA, 20 bp, Homo sapiens
caggcgtctgtctacgtggc

SEQ ID NO: 36174 - DNA, 21 bp, Homo sapiens
acaggcgtctgtctacgtggc

SEQ ID NO: 36175 - DNA, 19 bp, Homo sapiens
caggcgtctgtctacgtgg

SEQ ID NO: 36176 - DNA, 18 bp, Homo sapiens
acaggcgtctgtctacgt

SEQ ID NO: 36177 - DNA, 22 bp, Homo sapiens
tgcggtggggccggaggggcgt

SEQ ID NO: 36178 - DNA, 23 bp, Homo sapiens
tgcggtggggccggaggggcgtc

SEQ ID NO: 36179 - DNA, 24 bp, Homo sapiens
tgcggtggggccggaggggcgtca

SEQ ID NO: 36180 - DNA, 21 bp, Homo sapiens
cggtggggccggaggggcgtc

SEQ ID NO: 36181 - DNA, 22 bp, Homo sapiens
cggtggggccggaggggcgtca

SEQ ID NO: 36182 - DNA, 23 bp, Homo sapiens
cggtggggccggaggggcgtcac

SEQ ID NO: 36183 - DNA, 21 bp, Homo sapiens
ggtggggccggaggggcgtca

SEQ ID NO: 36184 - DNA, 20 bp, Homo sapiens
tgacgccccttctgattctg

SEQ ID NO: 36185 - DNA, 21 bp, Homo sapiens
tgacgccccttctgattctgc

SEQ ID NO: 36186 - DNA, 22 bp, Homo sapiens
tgacgccccttctgattctgcc

SEQ ID NO: 36187 - DNA, 24 bp, Homo sapiens
tgacgccccttctgattctgcctc

SEQ ID NO: 36188 - DNA, 25 bp, Homo sapiens
tgacgccccttctgattctgcctca

SEQ ID NO: 36189 - DNA, 22 bp, Homo sapiens
gacgccccttctgattctgcct

SEQ ID NO: 36190 - DNA, 16 bp, Homo sapiens
acgccccttctgattc

SEQ ID NO: 36191 - DNA, 17 bp, Homo sapiens
acgccccttctgattct

SEQ ID NO: 36192 - DNA, 20 bp, Homo sapiens
acgccccttctgattctgcc

SEQ ID NO: 36193 - DNA, 21 bp, Homo sapiens
acgccccttctgattctgcct

SEQ ID NO: 36194 - DNA, 22 bp, Homo sapiens
acgccccttctgattctgcctc

SEQ ID NO: 36195 - DNA, 23 bp, Homo sapiens
acgccccttctgattctgcctca

SEQ ID NO: 36196 - DNA, 24 bp, Homo sapiens
acgccccttctgattctgcctcag

SEQ ID NO: 36197 - DNA, 25 bp, Homo sapiens
acgccccttctgattctgcctcaga

SEQ ID NO: 36198 - DNA, 23 bp, Homo sapiens
cgccccttctgattctgcctcag

SEQ ID NO: 36199 - DNA, 22 bp, Homo sapiens
ttcctctctgggaaatgggaca

SEQ ID NO: 36200 - DNA, 18 bp, Homo sapiens
gtcggctggcgggggtag

SEQ ID NO: 36201 - DNA, 20 bp, Homo sapiens
gtcggctggcgggggtagag

SEQ ID NO: 36202 - DNA, 21 bp, Homo sapiens
gtcggctggcgggggtagagc

SEQ ID NO: 36203 - DNA, 22 bp, Homo sapiens
ctggcgggggtagagctggctg

SEQ ID NO: 36204 - DNA, 23 bp, Homo sapiens
ctggcgggggtagagctggctgc

SEQ ID NO: 36205 - DNA, 20 bp, Homo sapiens
tggcgggggtagagctggct

SEQ ID NO: 36206 - DNA, 21 bp, Homo sapiens
tggcgggggtagagctggctg

SEQ ID NO: 36207 - DNA, 23 bp, Homo sapiens
tggcgggggtagagctggctgca

SEQ ID NO: 36208 - DNA, 24 bp, Homo sapiens
tggcgggggtagagctggctgcag

SEQ ID NO: 36209 - DNA, 19 bp, Homo sapiens
ggcccctctcagctgctgc

SEQ ID NO: 36210 - DNA, 24 bp, Homo sapiens
cctctcagctgctgccctctccag

SEQ ID NO: 36211 - DNA, 19 bp, Homo sapiens
tctcagctgctgccctctc

SEQ ID NO: 36212 - DNA, 20 bp, Homo sapiens
tctcagctgctgccctctcc

SEQ ID NO: 36213 - DNA, 21 bp, Homo sapiens
tctcagctgctgccctctcca

SEQ ID NO: 36214 - DNA, 23 bp, Homo sapiens
tctcagctgctgccctctccagg

SEQ ID NO: 36215 - DNA, 24 bp, Homo sapiens
tctcagctgctgccctctccaggt

SEQ ID NO: 36216 - DNA, 25 bp, Homo sapiens
tctcagctgctgccctctccaggtc

SEQ ID NO: 36217 - DNA, 24 bp, Homo sapiens
ctcagctgctgccctctccaggtc

SEQ ID NO: 36218 - DNA, 27 bp, Homo sapiens
ttccctatctcactctcctcagacatc

SEQ ID NO: 36219 - DNA, 20 bp, Homo sapiens
ctatctcactctcctcagac

SEQ ID NO: 36220 - DNA, 20 bp, Homo sapiens
cctatctcactctcctcaga

SEQ ID NO: 36221 - DNA, 23 bp, Homo sapiens
ttccctatctcactctcctcaga

SEQ ID NO: 36222 - DNA, 21 bp, Homo sapiens
tccctatctcactctcctcag

SEQ ID NO: 36223 - DNA, 23 bp, Homo sapiens
tttccctatctcactctcctcag

SEQ ID NO: 36224 - DNA, 20 bp, Homo sapiens
tccctatctcactctcctca

SEQ ID NO: 36225 - DNA, 21 bp, Homo sapiens
ttccctatctcactctcctca

SEQ ID NO: 36226 - DNA, 22 bp, Homo sapiens
tttccctatctcactctcctca

SEQ ID NO: 36227 - DNA, 16 bp, Homo sapiens
gtatggatgtgttgac

SEQ ID NO: 36228 - DNA, 21 bp, Homo sapiens
gtgtggtatggatgtgttgac

SEQ ID NO: 36229 - DNA, 23 bp, Homo sapiens
gggagggtgtggtatggatgtgt

SEQ ID NO: 36230 - DNA, 21 bp, Homo sapiens
gggagggtgtggtatggatgt

SEQ ID NO: 36231 - DNA, 23 bp, Homo sapiens
cagggagggtgtggtatggatgt

SEQ ID NO: 36232 - DNA, 21 bp, Homo sapiens
agggagggtgtggtatggatg

SEQ ID NO: 36233 - DNA, 22 bp, Homo sapiens
ggggatgtgcatgctggttggg

SEQ ID NO: 36234 - DNA, 23 bp, Homo sapiens
gggggatgtgcatgctggttggg

SEQ ID NO: 36235 - DNA, 21 bp, Homo sapiens
ggggatgtgcatgctggttgg

SEQ ID NO: 36236 - DNA, 22 bp, Homo sapiens
gggggatgtgcatgctggttgg

SEQ ID NO: 36237 - DNA, 23 bp, Homo sapiens
ggggggatgtgcatgctggttgg

SEQ ID NO: 36238 - DNA, 21 bp, Homo sapiens
gggggatgtgcatgctggttg

SEQ ID NO: 36239 - DNA, 22 bp, Homo sapiens
ggggggatgtgcatgctggttg

SEQ ID NO: 36240 - DNA, 20 bp, Homo sapiens
gggggatgtgcatgctggtt

SEQ ID NO: 36241 - DNA, 19 bp, Homo sapiens
gggggatgtgcatgctggt

SEQ ID NO: 36242 - DNA, 20 bp, Homo sapiens
ggggggatgtgcatgctggt

SEQ ID NO: 36243 - DNA, 19 bp, Homo sapiens
ggggggatgtgcatgctgg

SEQ ID NO: 36244 - DNA, 17 bp, Homo sapiens
gggggatgtgcatgctg

SEQ ID NO: 36245 - DNA, 18 bp, Homo sapiens
ggggggatgtgcatgctg

SEQ ID NO: 36246 - DNA, 17 bp, Homo sapiens
ggggggatgtgcatgct

SEQ ID NO: 36247 - DNA, 16 bp, Homo sapiens
tcgtcggctaaggaag

SEQ ID NO: 36248 - DNA, 18 bp, Homo sapiens
tcgtcggctaaggaagtc

SEQ ID NO: 36249 - DNA, 19 bp, Homo sapiens
tcggctaaggaagtcctgt

SEQ ID NO: 36250 - DNA, 19 bp, Homo sapiens
gctaaggaagtcctgtgct

SEQ ID NO: 36251 - DNA, 23 bp, Homo sapiens
gctaaggaagtcctgtgctcagt

SEQ ID NO: 36252 - DNA, 24 bp, Homo sapiens
gctaaggaagtcctgtgctcagtt

SEQ ID NO: 36253 - DNA, 25 bp, Homo sapiens
gctaaggaagtcctgtgctcagttt

SEQ ID NO: 36254 - DNA, 26 bp, Homo sapiens
gctaaggaagtcctgtgctcagtttt

SEQ ID NO: 36255 - DNA, 27 bp, Homo sapiens
gctaaggaagtcctgtgctcagttttg

SEQ ID NO: 36256 - DNA, 28 bp, Homo sapiens
gctaaggaagtcctgtgctcagttttgt

SEQ ID NO: 36257 - DNA, 24 bp, Homo sapiens
taaggaagtcctgtgctcagtttt

SEQ ID NO: 36258 - DNA, 19 bp, Homo sapiens
ggagtcgctcggagcagtc

SEQ ID NO: 36259 - DNA, 24 bp, Homo sapiens
tctctcggagtcgctcggagcagt

SEQ ID NO: 36260 - DNA, 21 bp, Homo sapiens
tctcggagtcgctcggagcag

SEQ ID NO: 36261 - DNA, 21 bp, Homo sapiens
tctctcggagtcgctcggagc

SEQ ID NO: 36262 - DNA, 24 bp, Homo sapiens
gcctctctcggagtcgctcggagc

SEQ ID NO: 36263 - DNA, 23 bp, Homo sapiens
gcctctctcggagtcgctcggag

SEQ ID NO: 36264 - DNA, 16 bp, Homo sapiens
ctcggagtcgctcgga

SEQ ID NO: 36265 - DNA, 19 bp, Homo sapiens
tctctcggagtcgctcgga

SEQ ID NO: 36266 - DNA, 21 bp, Homo sapiens
cctctctcggagtcgctcgga

SEQ ID NO: 36267 - DNA, 21 bp, Homo sapiens
gcctctctcggagtcgctcgg

SEQ ID NO: 36268 - DNA, 27 bp, Homo sapiens
ttcgccacttccctccctgcagattac

SEQ ID NO: 36269 - DNA, 24 bp, Homo sapiens
tcgccacttccctccctgcagatt

SEQ ID NO: 36270 - DNA, 25 bp, Homo sapiens
ttcgccacttccctccctgcagatt

SEQ ID NO: 36271 - DNA, 24 bp, Homo sapiens
ttcgccacttccctccctgcagat

SEQ ID NO: 36272 - DNA, 22 bp, Homo sapiens
tcgccacttccctccctgcaga

SEQ ID NO: 36273 - DNA, 23 bp, Homo sapiens
ttcgccacttccctccctgcaga

SEQ ID NO: 36274 - DNA, 21 bp, Homo sapiens
tcgccacttccctccctgcag

SEQ ID NO: 36275 - DNA, 21 bp, Homo sapiens
ttcgccacttccctccctgca

SEQ ID NO: 36276 - DNA, 20 bp, Homo sapiens
ttcgccacttccctccctgc

SEQ ID NO: 36277 - DNA, 19 bp, Homo sapiens
ttcgccacttccctccctg

SEQ ID NO: 36278 - DNA, 23 bp, Homo sapiens
ctgggagaagagtggtgaagaag

SEQ ID NO: 36279 - DNA, 22 bp, Homo sapiens
ctgggagaagagtggtgaagaa

SEQ ID NO: 36280 - DNA, 23 bp, Homo sapiens
gctgggagaagagtggtgaagaa

SEQ ID NO: 36281 - DNA, 24 bp, Homo sapiens
ggctgggagaagagtggtgaagaa

SEQ ID NO: 36282 - DNA, 22 bp, Homo sapiens
gctgggagaagagtggtgaaga

SEQ ID NO: 36283 - DNA, 23 bp, Homo sapiens
ggctgggagaagagtggtgaaga

SEQ ID NO: 36284 - DNA, 20 bp, Homo sapiens
ctgggagaagagtggtgaag

SEQ ID NO: 36285 - DNA, 22 bp, Homo sapiens
ggctgggagaagagtggtgaag

SEQ ID NO: 36286 - DNA, 20 bp, Homo sapiens
gctgggagaagagtggtgaa

SEQ ID NO: 36287 - DNA, 21 bp, Homo sapiens
ggctgggagaagagtggtgaa

SEQ ID NO: 36288 - DNA, 20 bp, Homo sapiens
ggctgggagaagagtggtga

SEQ ID NO: 36289 - DNA, 22 bp, Homo sapiens
acggctgggagaagagtggtga

SEQ ID NO: 36290 - DNA, 19 bp, Homo sapiens
ggctgggagaagagtggtg

SEQ ID NO: 36291 - DNA, 19 bp, Homo sapiens
ccagtgactgagctggagc

SEQ ID NO: 36292 - DNA, 20 bp, Homo sapiens
ccagtgactgagctggagcc

SEQ ID NO: 36293 - DNA, 23 bp, Homo sapiens
ccagtgactgagctggagccagg

SEQ ID NO: 36294 - DNA, 22 bp, Homo sapiens
cagtgactgagctggagccagg

SEQ ID NO: 36295 - DNA, 20 bp, Homo sapiens
agtgactgagctggagccag

SEQ ID NO: 36296 - DNA, 17 bp, Homo sapiens
tgactgagctggagcca

SEQ ID NO: 36297 - DNA, 19 bp, Homo sapiens
gctgacagcagggctggcc

SEQ ID NO: 36298 - DNA, 20 bp, Homo sapiens
gctgacagcagggctggccg

SEQ ID NO: 36299 - DNA, 21 bp, Homo sapiens
gctgacagcagggctggccgc

SEQ ID NO: 36300 - DNA, 23 bp, Homo sapiens
gctgacagcagggctggccgcta

SEQ ID NO: 36301 - DNA, 24 bp, Homo sapiens
gctgacagcagggctggccgctaa

SEQ ID NO: 36302 - DNA, 25 bp, Homo sapiens
gctgacagcagggctggccgctaac

SEQ ID NO: 36303 - DNA, 21 bp, Homo sapiens
cagcagggctggccgctaacg

SEQ ID NO: 36304 - DNA, 23 bp, Homo sapiens
gaaaagctgggttgagagggtag

SEQ ID NO: 36305 - DNA, 22 bp, Homo sapiens
aaaagctgggttgagagggtag

SEQ ID NO: 36306 - DNA, 23 bp, Homo sapiens
aaaagctgggttgagagggtaga

SEQ ID NO: 36307 - DNA, 24 bp, Homo sapiens
aaaagctgggttgagagggtagaa

SEQ ID NO: 36308 - DNA, 25 bp, Homo sapiens
aaaagctgggttgagagggtagaaa

SEQ ID NO: 36309 - DNA, 26 bp, Homo sapiens
aaaagctgggttgagagggtagaaaa

SEQ ID NO: 36310 - DNA, 21 bp, Homo sapiens
aaagctgggttgagagggtag

SEQ ID NO: 36311 - DNA, 22 bp, Homo sapiens
aaagctgggttgagagggtaga

SEQ ID NO: 36312 - DNA, 23 bp, Homo sapiens
aaagctgggttgagagggtagaa

SEQ ID NO: 36313 - DNA, 24 bp, Homo sapiens
aaagctgggttgagagggtagaaa

SEQ ID NO: 36314 - DNA, 25 bp, Homo sapiens
aaagctgggttgagagggtagaaaa

SEQ ID NO: 36315 - DNA, 27 bp, Homo sapiens
ttggtccccttcaaccagctgtagcta

SEQ ID NO: 36316 - DNA, 28 bp, Homo sapiens
tttggtccccttcaaccagctgtagcta

SEQ ID NO: 36317 - DNA, 21 bp, Homo sapiens
tggtccccttcaaccagctgt

SEQ ID NO: 36318 - DNA, 20 bp, Homo sapiens
ttggtccccttcaaccagct

SEQ ID NO: 36319 - DNA, 21 bp, Homo sapiens
tttggtccccttcaaccagct

SEQ ID NO: 36320 - DNA, 28 bp, Homo sapiens
agctggtaaaatggaaccaaatcgcctc

SEQ ID NO: 36321 - DNA, 27 bp, Homo sapiens
agctggtaaaatggaaccaaatcgcct

SEQ ID NO: 36322 - DNA, 26 bp, Homo sapiens
agctggtaaaatggaaccaaatcgcc

SEQ ID NO: 36323 - DNA, 22 bp, Homo sapiens
tggtaaaatggaaccaaatcgc

SEQ ID NO: 36324 - DNA, 24 bp, Homo sapiens
gctggtaaaatggaaccaaatcgc

SEQ ID NO: 36325 - DNA, 25 bp, Homo sapiens
agctggtaaaatggaaccaaatcgc

SEQ ID NO: 36326 - DNA, 23 bp, Homo sapiens
gctggtaaaatggaaccaaatcg

SEQ ID NO: 36327 - DNA, 21 bp, Homo sapiens
agctggtaaaatggaaccaaa

SEQ ID NO: 36328 - DNA, 20 bp, Homo sapiens
agctggtaaaatggaaccaa

SEQ ID NO: 36329 - DNA, 28 bp, Homo sapiens
tggaatgtaaagaagtatgtatttttgg

SEQ ID NO: 36330 - DNA, 27 bp, Homo sapiens
tggaatgtaaagaagtatgtatttttg

SEQ ID NO: 36331 - DNA, 26 bp, Homo sapiens
tggaatgtaaagaagtatgtattttt

SEQ ID NO: 36332 - DNA, 25 bp, Homo sapiens
tggaatgtaaagaagtatgtatttt

SEQ ID NO: 36333 - DNA, 22 bp, Homo sapiens
gaatgtaaagaagtatgtattt

SEQ ID NO: 36334 - DNA, 24 bp, Homo sapiens
tggaatgtaaagaagtatgtattt

SEQ ID NO: 36335 - DNA, 21 bp, Homo sapiens
gaatgtaaagaagtatgtatt

SEQ ID NO: 36336 - DNA, 22 bp, Homo sapiens
ggaatgtaaagaagtatgtatt

SEQ ID NO: 36337 - DNA, 23 bp, Homo sapiens
tggaatgtaaagaagtatgtatt

SEQ ID NO: 36338 - DNA, 21 bp, Homo sapiens
ggaatgtaaagaagtatgtat

SEQ ID NO: 36339 - DNA, 18 bp, Homo sapiens
cgggctgtccggaggggt

SEQ ID NO: 36340 - DNA, 20 bp, Homo sapiens
cgggctgtccggaggggtcg

SEQ ID NO: 36341 - DNA, 21 bp, Homo sapiens
cgggctgtccggaggggtcgg

SEQ ID NO: 36342 - DNA, 22 bp, Homo sapiens
cgggctgtccggaggggtcggc

SEQ ID NO: 36343 - DNA, 24 bp, Homo sapiens
cgggctgtccggaggggtcggctt

SEQ ID NO: 36344 - DNA, 25 bp, Homo sapiens
cgggctgtccggaggggtcggcttt

SEQ ID NO: 36345 - DNA, 26 bp, Homo sapiens
cgggctgtccggaggggtcggctttc

SEQ ID NO: 36346 - DNA, 24 bp, Homo sapiens
gggctgtccggaggggtcggcttt

SEQ ID NO: 36347 - DNA, 23 bp, Homo sapiens
gaaaagctgggttgagagggtaa

SEQ ID NO: 36348 - DNA, 24 bp, Homo sapiens
gaaaagctgggttgagagggtaag

SEQ ID NO: 36349 - DNA, 22 bp, Homo sapiens
aaaagctgggttgagagggtaa

SEQ ID NO: 36350 - DNA, 23 bp, Homo sapiens
aaaagctgggttgagagggtaag

SEQ ID NO: 36351 - DNA, 24 bp, Homo sapiens
aaaagctgggttgagagggtaaga

SEQ ID NO: 36352 - DNA, 25 bp, Homo sapiens
aaaagctgggttgagagggtaagaa

SEQ ID NO: 36353 - DNA, 21 bp, Homo sapiens
aaagctgggttgagagggtaa

SEQ ID NO: 36354 - DNA, 22 bp, Homo sapiens
aaagctgggttgagagggtaag

SEQ ID NO: 36355 - DNA, 20 bp, Homo sapiens
aatgaggctaatgcactact

SEQ ID NO: 36356 - DNA, 18 bp, Homo sapiens
atgaggctaatgcactac

SEQ ID NO: 36357 - DNA, 19 bp, Homo sapiens
atgaggctaatgcactact

SEQ ID NO: 36358 - DNA, 20 bp, Homo sapiens
atgaggctaatgcactactt

SEQ ID NO: 36359 - DNA, 21 bp, Homo sapiens
atgaggctaatgcactacttc

SEQ ID NO: 36360 - DNA, 26 bp, Homo sapiens
atgaggctaatgcactacttcacatg

SEQ ID NO: 36361 - DNA, 27 bp, Homo sapiens
atgaggctaatgcactacttcacatga

SEQ ID NO: 36362 - DNA, 16 bp, Homo sapiens
aggctaatgcactact

SEQ ID NO: 36363 - DNA, 24 bp, Homo sapiens
cgtgtcttgtgttgcagccggagg

SEQ ID NO: 36364 - DNA, 25 bp, Homo sapiens
tcgtgtcttgtgttgcagccggagg

SEQ ID NO: 36365 - DNA, 23 bp, Homo sapiens
cgtgtcttgtgttgcagccggag

SEQ ID NO: 36366 - DNA, 24 bp, Homo sapiens
tcgtgtcttgtgttgcagccggag

SEQ ID NO: 36367 - DNA, 22 bp, Homo sapiens
cgtgtcttgtgttgcagccgga

SEQ ID NO: 36368 - DNA, 23 bp, Homo sapiens
tcgtgtcttgtgttgcagccgga

SEQ ID NO: 36369 - DNA, 24 bp, Homo sapiens
ctcgtgtcttgtgttgcagccgga

SEQ ID NO: 36370 - DNA, 21 bp, Homo sapiens
cgtgtcttgtgttgcagccgg

SEQ ID NO: 36371 - DNA, 20 bp, Homo sapiens
cgtgtcttgtgttgcagccg

SEQ ID NO: 36372 - DNA, 21 bp, Homo sapiens
tcgtgtcttgtgttgcagccg

SEQ ID NO: 36373 - DNA, 20 bp, Homo sapiens
tcgtgtcttgtgttgcagcc

SEQ ID NO: 36374 - DNA, 21 bp, Homo sapiens
ctcgtgtcttgtgttgcagcc

SEQ ID NO: 36375 - DNA, 19 bp, Homo sapiens
tcgtgtcttgtgttgcagc

SEQ ID NO: 36376 - DNA, 16 bp, Homo sapiens
gtgtcttgtgttgcag

SEQ ID NO: 36377 - DNA, 16 bp, Homo sapiens
ggacccgggcgctgct

SEQ ID NO: 36378 - DNA, 24 bp, Homo sapiens
tacaacacaggacccgggcgctgc

SEQ ID NO: 36379 - DNA, 26 bp, Homo sapiens
gctacaacacaggacccgggcgctgc

SEQ ID NO: 36380 - DNA, 24 bp, Homo sapiens
gctacaacacaggacccgggcgct

SEQ ID NO: 36381 - DNA, 21 bp, Homo sapiens
tacaacacaggacccgggcgc

SEQ ID NO: 36382 - DNA, 22 bp, Homo sapiens
ctacaacacaggacccgggcgc

SEQ ID NO: 36383 - DNA, 23 bp, Homo sapiens
gctacaacacaggacccgggcgc

SEQ ID NO: 36384 - DNA, 24 bp, Homo sapiens
ggctacaacacaggacccgggcgc

SEQ ID NO: 36385 - DNA, 20 bp, Homo sapiens
tacaacacaggacccgggcg

SEQ ID NO: 36386 - DNA, 21 bp, Homo sapiens
ctacaacacaggacccgggcg

SEQ ID NO: 36387 - DNA, 22 bp, Homo sapiens
gctacaacacaggacccgggcg

SEQ ID NO: 36388 - DNA, 23 bp, Homo sapiens
ggctacaacacaggacccgggcg

SEQ ID NO: 36389 - DNA, 21 bp, Homo sapiens
gctacaacacaggacccgggc

SEQ ID NO: 36390 - DNA, 23 bp, Homo sapiens
gggctacaacacaggacccgggc

SEQ ID NO: 36391 - DNA, 20 bp, Homo sapiens
gctacaacacaggacccggg

SEQ ID NO: 36392 - DNA, 21 bp, Homo sapiens
ggctacaacacaggacccggg

SEQ ID NO: 36393 - DNA, 20 bp, Homo sapiens
ggctacaacacaggacccgg

SEQ ID NO: 36394 - DNA, 18 bp, Homo sapiens
gctacaacacaggacccg

SEQ ID NO: 36395 - DNA, 19 bp, Homo sapiens
ggctacaacacaggacccg

SEQ ID NO: 36396 - DNA, 17 bp, Homo sapiens
gctacaacacaggaccc

SEQ ID NO: 36397 - DNA, 17 bp, Homo sapiens
ggctacaacacaggacc

SEQ ID NO: 36398 - DNA, 17 bp, Homo sapiens
gggctacaacacaggac

SEQ ID NO: 36399 - DNA, 21 bp, Homo sapiens
tgtgagtagaccacttgagcc

SEQ ID NO: 36400 - DNA, 20 bp, Homo sapiens
tgtgagtagaccacttgagc

SEQ ID NO: 36401 - DNA, 25 bp, Homo sapiens
aggctgatgtgagtagaccacttga

SEQ ID NO: 36402 - DNA, 26 bp, Homo sapiens
gaggctgatgtgagtagaccacttga

SEQ ID NO: 36403 - DNA, 25 bp, Homo sapiens
gaggctgatgtgagtagaccacttg

SEQ ID NO: 36404 - DNA, 24 bp, Homo sapiens
gaggctgatgtgagtagaccactt

SEQ ID NO: 36405 - DNA, 22 bp, Homo sapiens
aggctgatgtgagtagaccact

SEQ ID NO: 36406 - DNA, 22 bp, Homo sapiens
gaggctgatgtgagtagaccac

SEQ ID NO: 36407 - DNA, 21 bp, Homo sapiens
gaggctgatgtgagtagacca

SEQ ID NO: 36408 - DNA, 20 bp, Homo sapiens
gaggctgatgtgagtagacc

SEQ ID NO: 36409 - DNA, 19 bp, Homo sapiens
gaggctgatgtgagtagac

SEQ ID NO: 36410 - DNA, 21 bp, Homo sapiens
acagtcactgtgggtacatgc

SEQ ID NO: 36411 - DNA, 21 bp, Homo sapiens
cagtcactgtgggtacatgct

SEQ ID NO: 36412 - DNA, 20 bp, Homo sapiens
agtcactgtgggtacatgct

SEQ ID NO: 36413 - DNA, 22 bp, Homo sapiens
agtcttgtgatgtcttgcttaa

SEQ ID NO: 36414 - DNA, 16 bp, Homo sapiens
gtcaatagagtcttgt

SEQ ID NO: 36415 - DNA, 18 bp, Homo sapiens
tcatcagaatatgggtat

SEQ ID NO: 36416 - DNA, 25 bp, Homo sapiens
aaactaatatacccatattctgatg

SEQ ID NO: 36417 - DNA, 23 bp, Homo sapiens
aaactaatatacccatattctga

SEQ ID NO: 36418 - DNA, 22 bp, Homo sapiens
tagtggtcagagggcttatgat

SEQ ID NO: 36419 - DNA, 23 bp, Homo sapiens
tagtggtcagagggcttatgata

SEQ ID NO: 36420 - DNA, 24 bp, Homo sapiens
tagtggtcagagggcttatgatat

SEQ ID NO: 36421 - DNA, 20 bp, Homo sapiens
agtggtcagagggcttatga

SEQ ID NO: 36422 - DNA, 21 bp, Homo sapiens
agtggtcagagggcttatgat

SEQ ID NO: 36423 - DNA, 22 bp, Homo sapiens
agtggtcagagggcttatgata

SEQ ID NO: 36424 - DNA, 20 bp, Homo sapiens
tggtcagagggcttatgata

SEQ ID NO: 36425 - DNA, 22 bp, Homo sapiens
tggtcagagggcttatgatata

SEQ ID NO: 36426 - DNA, 22 bp, Homo sapiens
gtcagagggcttatgatatatt

SEQ ID NO: 36427 - DNA, 23 bp, Homo sapiens
tccctgagcaaagccactgggaa

SEQ ID NO: 36428 - DNA, 22 bp, Homo sapiens
tccctgagcaaagccactggga

SEQ ID NO: 36429 - DNA, 21 bp, Homo sapiens
tccctgagcaaagccactggg

SEQ ID NO: 36430 - DNA, 20 bp, Homo sapiens
tccctgagcaaagccactgg

SEQ ID NO: 36431 - DNA, 19 bp, Homo sapiens
tccctgagcaaagccactg

SEQ ID NO: 36432 - DNA, 23 bp, Homo sapiens
tggtctgcaaagagatgactgtg

SEQ ID NO: 36433 - DNA, 24 bp, Homo sapiens
tggtctgcaaagagatgactgtga

SEQ ID NO: 36434 - DNA, 20 bp, Homo sapiens
aaagagatgactgtgaatcc

SEQ ID NO: 36435 - DNA, 23 bp, Homo sapiens
tgctggccggatgggacaggagg

SEQ ID NO: 36436 - DNA, 24 bp, Homo sapiens
tgctggccggatgggacaggaggc

SEQ ID NO: 36437 - DNA, 27 bp, Homo sapiens
tgctggccggatgggacaggaggcatg

SEQ ID NO: 36438 - DNA, 21 bp, Homo sapiens
ctggccggatgggacaggagg

SEQ ID NO: 36439 - DNA, 22 bp, Homo sapiens
ctggccggatgggacaggaggc

SEQ ID NO: 36440 - DNA, 23 bp, Homo sapiens
ctggccggatgggacaggaggca

SEQ ID NO: 36441 - DNA, 24 bp, Homo sapiens
ctggccggatgggacaggaggcat

SEQ ID NO: 36442 - DNA, 25 bp, Homo sapiens
ctggccggatgggacaggaggcatg

SEQ ID NO: 36443 - DNA, 18 bp, Homo sapiens
tggccggatgggacagga

SEQ ID NO: 36444 - DNA, 19 bp, Homo sapiens
tggccggatgggacaggag

SEQ ID NO: 36445 - DNA, 20 bp, Homo sapiens
tggccggatgggacaggagg

SEQ ID NO: 36446 - DNA, 21 bp, Homo sapiens
tggccggatgggacaggaggc

SEQ ID NO: 36447 - DNA, 22 bp, Homo sapiens
tggccggatgggacaggaggca

SEQ ID NO: 36448 - DNA, 24 bp, Homo sapiens
tggccggatgggacaggaggcatg

SEQ ID NO: 36449 - DNA, 23 bp, Homo sapiens
gccggatgggacaggaggcatga

SEQ ID NO: 36450 - DNA, 27 bp, Homo sapiens
aatgcctttctgtcttttctggtccag

SEQ ID NO: 36451 - DNA, 22 bp, Homo sapiens
tgcctttctgtcttttctggtc

SEQ ID NO: 36452 - DNA, 23 bp, Homo sapiens
tgcctttctgtcttttctggtcc

SEQ ID NO: 36453 - DNA, 24 bp, Homo sapiens
tgcctttctgtcttttctggtcca

SEQ ID NO: 36454 - DNA, 26 bp, Homo sapiens
tgcctttctgtcttttctggtccagg

SEQ ID NO: 36455 - DNA, 20 bp, Homo sapiens
cctttctgtcttttctggtc

SEQ ID NO: 36456 - DNA, 23 bp, Homo sapiens
cctttctgtcttttctggtccag

SEQ ID NO: 36457 - DNA, 24 bp, Homo sapiens
cctttctgtcttttctggtccagg

SEQ ID NO: 36458 - DNA, 25 bp, Homo sapiens
cctttctgtcttttctggtccaggt

SEQ ID NO: 36459 - DNA, 22 bp, Homo sapiens
ctttctgtcttttctggtccag

SEQ ID NO: 36460 - DNA, 23 bp, Homo sapiens
ctttctgtcttttctggtccagg

SEQ ID NO: 36461 - DNA, 22 bp, Homo sapiens
tttctgtcttttctggtccagg

SEQ ID NO: 36462 - DNA, 22 bp, Homo sapiens
taaagactagacttcgctatga

SEQ ID NO: 36463 - DNA, 24 bp, Homo sapiens
tctaaagactagacttcgctatga

SEQ ID NO: 36464 - DNA, 19 bp, Homo sapiens
ctaaagactagacttcgct

SEQ ID NO: 36465 - DNA, 20 bp, Homo sapiens
tctaaagactagacttcgct

SEQ ID NO: 36466 - DNA, 23 bp, Homo sapiens
atcacatctaaagactagacttc

SEQ ID NO: 36467 - DNA, 16 bp, Homo sapiens
atcacatctaaagact

SEQ ID NO: 36468 - DNA, 16 bp, Homo sapiens
aagtcctgcgcgtccc

SEQ ID NO: 36469 - DNA, 26 bp, Homo sapiens
aagtcctgcgcgtcccagatgcccaa

SEQ ID NO: 36470 - DNA, 25 bp, Homo sapiens
agtcctgcgcgtcccagatgcccaa

SEQ ID NO: 36471 - DNA, 24 bp, Homo sapiens
tcctgcgcgtcccagatgcccaac

SEQ ID NO: 36472 - DNA, 21 bp, Homo sapiens
ctgcgcgtcccagatgcccaa

SEQ ID NO: 36473 - DNA, 20 bp, Homo sapiens
tgcgcgtcccagatgcccaa

SEQ ID NO: 36474 - DNA, 21 bp, Homo sapiens
tgcgcgtcccagatgcccaac

SEQ ID NO: 36475 - DNA, 22 bp, Homo sapiens
tgcgcgtcccagatgcccaact

SEQ ID NO: 36476 - DNA, 23 bp, Homo sapiens
tgcgcgtcccagatgcccaacta

SEQ ID NO: 36477 - DNA, 18 bp, Homo sapiens
gtcccagatgcccaacta

SEQ ID NO: 36478 - DNA, 16 bp, Homo sapiens
ccagatgcccaactaa

SEQ ID NO: 36479 - DNA, 16 bp, Homo sapiens
gtagcttcctggcaac

SEQ ID NO: 36480 - DNA, 22 bp, Homo sapiens
gattctgtagcttcctggcaac

SEQ ID NO: 36481 - DNA, 21 bp, Homo sapiens
gattctgtagcttcctggcaa

SEQ ID NO: 36482 - DNA, 22 bp, Homo sapiens
ggattctgtagcttcctggcaa

SEQ ID NO: 36483 - DNA, 23 bp, Homo sapiens
gggattctgtagcttcctggcaa

SEQ ID NO: 36484 - DNA, 18 bp, Homo sapiens
gattctgtagcttcctgg

SEQ ID NO: 36485 - DNA, 19 bp, Homo sapiens
ggattctgtagcttcctgg

SEQ ID NO: 36486 - DNA, 19 bp, Homo sapiens
gggattctgtagcttcctg

SEQ ID NO: 36487 - DNA, 21 bp, Homo sapiens
tcgggattctgtagcttcctg

SEQ ID NO: 36488 - DNA, 20 bp, Homo sapiens
tcgggattctgtagcttcct

SEQ ID NO: 36489 - DNA, 21 bp, Homo sapiens
ctcgggattctgtagcttcct

SEQ ID NO: 36490 - DNA, 23 bp, Homo sapiens
aactcgggattctgtagcttcct

SEQ ID NO: 36491 - DNA, 24 bp, Homo sapiens
taactcgggattctgtagcttcct

SEQ ID NO: 36492 - DNA, 17 bp, Homo sapiens
gggattctgtagcttcc

SEQ ID NO: 36493 - DNA, 18 bp, Homo sapiens
cgggattctgtagcttcc

SEQ ID NO: 36494 - DNA, 16 bp, Homo sapiens
gggattctgtagcttc

SEQ ID NO: 36495 - DNA, 17 bp, Homo sapiens
cgggattctgtagcttc

SEQ ID NO: 36496 - DNA, 19 bp, Homo sapiens
ctcgggattctgtagcttc

SEQ ID NO: 36497 - DNA, 16 bp, Homo sapiens
cgggattctgtagctt

SEQ ID NO: 36498 - DNA, 22 bp, Homo sapiens
acaggccatcagcagtccaatg

SEQ ID NO: 36499 - DNA, 21 bp, Homo sapiens
caggccatcagcagtccaatg

SEQ ID NO: 36500 - DNA, 22 bp, Homo sapiens
caggccatcagcagtccaatga

SEQ ID NO: 36501 - DNA, 19 bp, Homo sapiens
aggccatcagcagtccaat

SEQ ID NO: 36502 - DNA, 20 bp, Homo sapiens
aggccatcagcagtccaatg

SEQ ID NO: 36503 - DNA, 21 bp, Homo sapiens
aggccatcagcagtccaatga

SEQ ID NO: 36504 - DNA, 22 bp, Homo sapiens
ttcattggactgctgatggccc

SEQ ID NO: 36505 - DNA, 24 bp, Homo sapiens
ttcattggactgctgatggcccgt

SEQ ID NO: 36506 - DNA, 21 bp, Homo sapiens
tcattggactgctgatggccc

SEQ ID NO: 36507 - DNA, 23 bp, Homo sapiens
tcattggactgctgatggcccgt

SEQ ID NO: 36508 - DNA, 21 bp, Homo sapiens
cattggactgctgatggcccg

SEQ ID NO: 36509 - DNA, 22 bp, Homo sapiens
cattggactgctgatggcccgt

SEQ ID NO: 36510 - DNA, 23 bp, Homo sapiens
cattggactgctgatggcccgtc

SEQ ID NO: 36511 - DNA, 24 bp, Homo sapiens
cattggactgctgatggcccgtca

SEQ ID NO: 36512 - DNA, 20 bp, Homo sapiens
attggactgctgatggcccg

SEQ ID NO: 36513 - DNA, 22 bp, Homo sapiens
attggactgctgatggcccgtc

SEQ ID NO: 36514 - DNA, 23 bp, Homo sapiens
attggactgctgatggcccgtca

SEQ ID NO: 36515 - DNA, 19 bp, Homo sapiens
agttgcctttttgttccca

SEQ ID NO: 36516 - DNA, 20 bp, Homo sapiens
agttgcctttttgttcccat

SEQ ID NO: 36517 - DNA, 21 bp, Homo sapiens
agttgcctttttgttcccatg

SEQ ID NO: 36518 - DNA, 23 bp, Homo sapiens
agttgcctttttgttcccatgct

SEQ ID NO: 36519 - DNA, 24 bp, Homo sapiens
agttgcctttttgttcccatgctg

SEQ ID NO: 36520 - DNA, 20 bp, Homo sapiens
gttgcctttttgttcccatg

SEQ ID NO: 36521 - DNA, 21 bp, Homo sapiens
gttgcctttttgttcccatgc

SEQ ID NO: 36522 - DNA, 22 bp, Homo sapiens
gttgcctttttgttcccatgct

SEQ ID NO: 36523 - DNA, 23 bp, Homo sapiens
gttgcctttttgttcccatgctg

SEQ ID NO: 36524 - DNA, 24 bp, Homo sapiens
gttgcctttttgttcccatgctgt

SEQ ID NO: 36525 - DNA, 19 bp, Homo sapiens
cataggcaccaaaaagcaa

SEQ ID NO: 36526 - DNA, 20 bp, Homo sapiens
cataggcaccaaaaagcaac

SEQ ID NO: 36527 - DNA, 21 bp, Homo sapiens
cataggcaccaaaaagcaaca

SEQ ID NO: 36528 - DNA, 22 bp, Homo sapiens
cataggcaccaaaaagcaacaa

SEQ ID NO: 36529 - DNA, 23 bp, Homo sapiens
cataggcaccaaaaagcaacaac

SEQ ID NO: 36530 - DNA, 20 bp, Homo sapiens
ataggcaccaaaaagcaaca

SEQ ID NO: 36531 - DNA, 22 bp, Homo sapiens
ataggcaccaaaaagcaacaac

SEQ ID NO: 36532 - DNA, 23 bp, Homo sapiens
ataggcaccaaaaagcaacaaca

SEQ ID NO: 36533 - DNA, 19 bp, Homo sapiens
taggcaccaaaaagcaaca

SEQ ID NO: 36534 - DNA, 22 bp, Homo sapiens
taggcaccaaaaagcaacaaca

SEQ ID NO: 36535 - DNA, 23 bp, Homo sapiens
aaacaccattgtcacactccaca

SEQ ID NO: 36536 - DNA, 21 bp, Homo sapiens
aaacaccattgtcacactcca

SEQ ID NO: 36537 - DNA, 21 bp, Homo sapiens
tggagtgtgacaatggtgttt

SEQ ID NO: 36538 - DNA, 23 bp, Homo sapiens
tggagtgtgacaatggtgtttgt

SEQ ID NO: 36539 - DNA, 24 bp, Homo sapiens
tggagtgtgacaatggtgtttgtg

SEQ ID NO: 36540 - DNA, 25 bp, Homo sapiens
tggagtgtgacaatggtgtttgtgt

SEQ ID NO: 36541 - DNA, 26 bp, Homo sapiens
tggagtgtgacaatggtgtttgtgtc

SEQ ID NO: 36542 - DNA, 27 bp, Homo sapiens
tggagtgtgacaatggtgtttgtgtct

SEQ ID NO: 36543 - DNA, 20 bp, Homo sapiens
aaacaccattgtcacactcc

SEQ ID NO: 36544 - DNA, 20 bp, Homo sapiens
ggagtgtgacaatggtgttt

SEQ ID NO: 36545 - DNA, 21 bp, Homo sapiens
ggagtgtgacaatggtgtttg

SEQ ID NO: 36546 - DNA, 20 bp, Homo sapiens
gagtgtgacaatggtgtttg

SEQ ID NO: 36547 - DNA, 22 bp, Homo sapiens
tatcaaacgccattatcacact

SEQ ID NO: 36548 - DNA, 23 bp, Homo sapiens
tatcaaacgccattatcacacta

SEQ ID NO: 36549 - DNA, 25 bp, Homo sapiens
tttagtgtgataatggcgtttgata

SEQ ID NO: 36550 - DNA, 21 bp, Homo sapiens
ttagtgtgataatggcgtttg

SEQ ID NO: 36551 - DNA, 22 bp, Homo sapiens
tttagtgtgataatggcgtttg

SEQ ID NO: 36552 - DNA, 18 bp, Homo sapiens
aaacgccattatcacact

SEQ ID NO: 36553 - DNA, 19 bp, Homo sapiens
aaacgccattatcacacta

SEQ ID NO: 36554 - DNA, 20 bp, Homo sapiens
aaacgccattatcacactaa

SEQ ID NO: 36555 - DNA, 21 bp, Homo sapiens
tttagtgtgataatggcgttt

SEQ ID NO: 36556 - DNA, 22 bp, Homo sapiens
aaacgccattatcacactaaat

SEQ ID NO: 36557 - DNA, 19 bp, Homo sapiens
aacgccattatcacactaa

SEQ ID NO: 36558 - DNA, 20 bp, Homo sapiens
aacgccattatcacactaaa

SEQ ID NO: 36559 - DNA, 21 bp, Homo sapiens
aacgccattatcacactaaat

SEQ ID NO: 36560 - DNA, 21 bp, Homo sapiens
acgccattatcacactaaata

SEQ ID NO: 36561 - DNA, 19 bp, Homo sapiens
cgccattatcacactaaat

SEQ ID NO: 36562 - DNA, 20 bp, Homo sapiens
cgccattatcacactaaata

SEQ ID NO: 36563 - DNA, 20 bp, Homo sapiens
gccattatcacactaaatag

SEQ ID NO: 36564 - DNA, 17 bp, Homo sapiens
tagctatttagtgtgat

SEQ ID NO: 36565 - DNA, 16 bp, Homo sapiens
gatatagagagcagga

SEQ ID NO: 36566 - DNA, 21 bp, Homo sapiens
gagacattgccagggagttta

SEQ ID NO: 36567 - DNA, 20 bp, Homo sapiens
gagacattgccagggagttt

SEQ ID NO: 36568 - DNA, 16 bp, Homo sapiens
acattgccagggagtt

SEQ ID NO: 36569 - DNA, 19 bp, Homo sapiens
gagacattgccagggagtt

SEQ ID NO: 36570 - DNA, 16 bp, Homo sapiens
cgagacattgccaggg

SEQ ID NO: 36571 - DNA, 17 bp, Homo sapiens
gccatgcactctgtagt

SEQ ID NO: 36572 - DNA, 23 bp, Homo sapiens
gatgttttaaggacactgaggga

SEQ ID NO: 36573 - DNA, 21 bp, Homo sapiens
atgttttaaggacactgaggg

SEQ ID NO: 36574 - DNA, 16 bp, Homo sapiens
ttgcggatttgccatc

SEQ ID NO: 36575 - DNA, 21 bp, Homo sapiens
aaaagtacttgcggatttgcc

SEQ ID NO: 36576 - DNA, 21 bp, Homo sapiens
caaaagtacttgcggatttgc

SEQ ID NO: 36577 - DNA, 23 bp, Homo sapiens
gtgcaaaagtacttgcggatttg

SEQ ID NO: 36578 - DNA, 24 bp, Homo sapiens
tctctgctctgctctccccaggcg

SEQ ID NO: 36579 - DNA, 24 bp, Homo sapiens
ttctctgctctgctctccccaggc

SEQ ID NO: 36580 - DNA, 22 bp, Homo sapiens
tctctgctctgctctccccagg

SEQ ID NO: 36581 - DNA, 23 bp, Homo sapiens
ttctctgctctgctctccccagg

SEQ ID NO: 36582 - DNA, 22 bp, Homo sapiens
ttctctgctctgctctccccag

SEQ ID NO: 36583 - DNA, 24 bp, Homo sapiens
gcttctctgctctgctctccccag

SEQ ID NO: 36584 - DNA, 25 bp, Homo sapiens
tgcttctctgctctgctctccccag

SEQ ID NO: 36585 - DNA, 27 bp, Homo sapiens
catgcttctctgctctgctctccccag

SEQ ID NO: 36586 - DNA, 26 bp, Homo sapiens
catgcttctctgctctgctctcccca

SEQ ID NO: 36587 - DNA, 20 bp, Homo sapiens
taggaccagaggggcttact

SEQ ID NO: 36588 - DNA, 21 bp, Homo sapiens
gtaggaccagaggggcttact

SEQ ID NO: 36589 - DNA, 23 bp, Homo sapiens
tgggatggtaggaccagaggggc

SEQ ID NO: 36590 - DNA, 22 bp, Homo sapiens
tgggatggtaggaccagagggg

SEQ ID NO: 36591 - DNA, 28 bp, Homo sapiens
ctagattgggatggtaggaccagagggg

SEQ ID NO: 36592 - DNA, 21 bp, Homo sapiens
tgggatggtaggaccagaggg

SEQ ID NO: 36593 - DNA, 22 bp, Homo sapiens
ttgggatggtaggaccagaggg

SEQ ID NO: 36594 - DNA, 21 bp, Homo sapiens
ttgggatggtaggaccagagg

SEQ ID NO: 36595 - DNA, 22 bp, Homo sapiens
attgggatggtaggaccagagg

SEQ ID NO: 36596 - DNA, 20 bp, Homo sapiens
ttgggatggtaggaccagag

SEQ ID NO: 36597 - DNA, 19 bp, Homo sapiens
tagattgggatggtaggac

SEQ ID NO: 36598 - DNA, 22 bp, Homo sapiens
ttggctgggtgctcttgtgcag

SEQ ID NO: 36599 - DNA, 21 bp, Homo sapiens
tggctgggtgctcttgtgcag

SEQ ID NO: 36600 - DNA, 22 bp, Homo sapiens
tggctgggtgctcttgtgcagt

SEQ ID NO: 36601 - DNA, 22 bp, Homo sapiens
ggctgggtgctcttgtgcagtg

SEQ ID NO: 36602 - DNA, 23 bp, Homo sapiens
ggctgggtgctcttgtgcagtga

SEQ ID NO: 36603 - DNA, 16 bp, Homo sapiens
cttgtgcagtgagcaa

SEQ ID NO: 36604 - DNA, 19 bp, Homo sapiens
tgcacatggcaacctagct

SEQ ID NO: 36605 - DNA, 21 bp, Homo sapiens
tgcacatggcaacctagctcc

SEQ ID NO: 36606 - DNA, 22 bp, Homo sapiens
tgcacatggcaacctagctccc

SEQ ID NO: 36607 - DNA, 24 bp, Homo sapiens
tgcacatggcaacctagctcccaa

SEQ ID NO: 36608 - DNA, 25 bp, Homo sapiens
tgcacatggcaacctagctcccaaa

SEQ ID NO: 36609 - DNA, 16 bp, Homo sapiens
gggggactgtgggctc

SEQ ID NO: 36610 - DNA, 21 bp, Homo sapiens
gggggactgtgggctcagcgc

SEQ ID NO: 36611 - DNA, 17 bp, Homo sapiens
ggactgtgggctcagcg

SEQ ID NO: 36612 - DNA, 18 bp, Homo sapiens
ggactgtgggctcagcgc

SEQ ID NO: 36613 - DNA, 19 bp, Homo sapiens
ggactgtgggctcagcgcg

SEQ ID NO: 36614 - DNA, 20 bp, Homo sapiens
ggactgtgggctcagcgcgt

SEQ ID NO: 36615 - DNA, 21 bp, Homo sapiens
ggactgtgggctcagcgcgtg

SEQ ID NO: 36616 - DNA, 22 bp, Homo sapiens
ggactgtgggctcagcgcgtgg

SEQ ID NO: 36617 - DNA, 23 bp, Homo sapiens
ggactgtgggctcagcgcgtggg

SEQ ID NO: 36618 - DNA, 24 bp, Homo sapiens
ggactgtgggctcagcgcgtgggg

SEQ ID NO: 36619 - DNA, 20 bp, Homo sapiens
ctgtgggctcagcgcgtggg

SEQ ID NO: 36620 - DNA, 16 bp, Homo sapiens
acccgagccggagcgg

SEQ ID NO: 36621 - DNA, 19 bp, Homo sapiens
gccacccgagccggagcgg

SEQ ID NO: 36622 - DNA, 20 bp, Homo sapiens
ccgccacccgagccggagcg

SEQ ID NO: 36623 - DNA, 21 bp, Homo sapiens
gccgccacccgagccggagcg

SEQ ID NO: 36624 - DNA, 19 bp, Homo sapiens
gccgccacccgagccggag

SEQ ID NO: 36625 - DNA, 20 bp, Homo sapiens
cgccgccacccgagccggag

SEQ ID NO: 36626 - DNA, 18 bp, Homo sapiens
gccgccacccgagccgga

SEQ ID NO: 36627 - DNA, 19 bp, Homo sapiens
cgccgccacccgagccgga

SEQ ID NO: 36628 - DNA, 21 bp, Homo sapiens
gtcgccgccacccgagccgga

SEQ ID NO: 36629 - DNA, 19 bp, Homo sapiens
gtcgccgccacccgagccg

SEQ ID NO: 36630 - DNA, 23 bp, Homo sapiens
cgccgtcgccgccacccgagccg

SEQ ID NO: 36631 - DNA, 19 bp, Homo sapiens
gccgtcgccgccacccgag

SEQ ID NO: 36632 - DNA, 21 bp, Homo sapiens
tgccgccgtcgccgccacccg

SEQ ID NO: 36633 - DNA, 20 bp, Homo sapiens
ctgccgccgtcgccgccacc

SEQ ID NO: 36634 - DNA, 19 bp, Homo sapiens
gtgagtgggagccccagtg

SEQ ID NO: 36635 - DNA, 22 bp, Homo sapiens
ccttcctcgtctgtctgcccca

SEQ ID NO: 36636 - DNA, 23 bp, Homo sapiens
ccttcctcgtctgtctgccccag

SEQ ID NO: 36637 - DNA, 24 bp, Homo sapiens
ccttcctcgtctgtctgccccagt

SEQ ID NO: 36638 - DNA, 25 bp, Homo sapiens
ccttcctcgtctgtctgccccagtc

SEQ ID NO: 36639 - DNA, 22 bp, Homo sapiens
cttcctcgtctgtctgccccag

SEQ ID NO: 36640 - DNA, 23 bp, Homo sapiens
cttcctcgtctgtctgccccagt

SEQ ID NO: 36641 - DNA, 18 bp, Homo sapiens
gcggcagggatcgcgggc

SEQ ID NO: 36642 - DNA, 17 bp, Homo sapiens
agggatcgcgggcgggt

SEQ ID NO: 36643 - DNA, 16 bp, Homo sapiens
gatcgcgggcgggtgg

SEQ ID NO: 36644 - DNA, 19 bp, Homo sapiens
cgcgggcgggtggcggcct

SEQ ID NO: 36645 - DNA, 18 bp, Homo sapiens
gggtggcggcctagggcg

SEQ ID NO: 36646 - DNA, 22 bp, Homo sapiens
tgaggtttggggaggatttgct

SEQ ID NO: 36647 - DNA, 18 bp, Homo sapiens
gaggtttggggaggattt

SEQ ID NO: 36648 - DNA, 19 bp, Homo sapiens
gaggtttggggaggatttg

SEQ ID NO: 36649 - DNA, 20 bp, Homo sapiens
gaggtttggggaggatttgc

SEQ ID NO: 36650 - DNA, 22 bp, Homo sapiens
gaggtttggggaggatttgctg

SEQ ID NO: 36651 - DNA, 23 bp, Homo sapiens
gaggtttggggaggatttgctgg

SEQ ID NO: 36652 - DNA, 19 bp, Homo sapiens
aggtttggggaggatttgc

SEQ ID NO: 36653 - DNA, 20 bp, Homo sapiens
aggtttggggaggatttgct

SEQ ID NO: 36654 - DNA, 21 bp, Homo sapiens
aggtttggggaggatttgctg

SEQ ID NO: 36655 - DNA, 22 bp, Homo sapiens
aggtttggggaggatttgctgg

SEQ ID NO: 36656 - DNA, 23 bp, Homo sapiens
aggtttggggaggatttgctggt

SEQ ID NO: 36657 - DNA, 26 bp, Homo sapiens
gtgtacagtagtctgcacattggtta

SEQ ID NO: 36658 - DNA, 27 bp, Homo sapiens
tgtgtacagtagtctgcacattggtta

SEQ ID NO: 36659 - DNA, 25 bp, Homo sapiens
gtgtacagtagtctgcacattggtt

SEQ ID NO: 36660 - DNA, 26 bp, Homo sapiens
tgtgtacagtagtctgcacattggtt

SEQ ID NO: 36661 - DNA, 24 bp, Homo sapiens
gtgtacagtagtctgcacattggt

SEQ ID NO: 36662 - DNA, 24 bp, Homo sapiens
tgtgtacagtagtctgcacattgg

SEQ ID NO: 36663 - DNA, 21 bp, Homo sapiens
gtgtacagtagtctgcacatt

SEQ ID NO: 36664 - DNA, 21 bp, Homo sapiens
atgtgtacagtagtctgcaca

SEQ ID NO: 36665 - DNA, 28 bp, Homo sapiens
ccagtgttcagactacctgttcaggagg

SEQ ID NO: 36666 - DNA, 28 bp, Homo sapiens
cccagtgttcagactacctgttcaggag

SEQ ID NO: 36667 - DNA, 25 bp, Homo sapiens
acccagtgttcagactacctgttca

SEQ ID NO: 36668 - DNA, 24 bp, Homo sapiens
acccagtgttcagactacctgttc

SEQ ID NO: 36669 - DNA, 23 bp, Homo sapiens
acccagtgttcagactacctgtt

SEQ ID NO: 36670 - DNA, 24 bp, Homo sapiens
aacccagtgttcagactacctgtt

SEQ ID NO: 36671 - DNA, 22 bp, Homo sapiens
acccagtgttcagactacctgt

SEQ ID NO: 36672 - DNA, 23 bp, Homo sapiens
aacccagtgttcagactacctgt

SEQ ID NO: 36673 - DNA, 24 bp, Homo sapiens
caacccagtgttcagactacctgt

SEQ ID NO: 36674 - DNA, 23 bp, Homo sapiens
caacccagtgttcagactacctg

SEQ ID NO: 36675 - DNA, 21 bp, Homo sapiens
aacccagtgttcagactacct

SEQ ID NO: 36676 - DNA, 22 bp, Homo sapiens
caacccagtgttcagactacct

SEQ ID NO: 36677 - DNA, 19 bp, Homo sapiens
tcactgtgggttctgggtt

SEQ ID NO: 36678 - DNA, 20 bp, Homo sapiens
tcactgtgggttctgggttg

SEQ ID NO: 36679 - DNA, 22 bp, Homo sapiens
tcactgtgggttctgggttggg

SEQ ID NO: 36680 - DNA, 27 bp, Homo sapiens
tcactgtgggttctgggttggggtgat

SEQ ID NO: 36681 - DNA, 17 bp, Homo sapiens
cactgtgggttctgggt

SEQ ID NO: 36682 - DNA, 19 bp, Homo sapiens
cactgtgggttctgggttg

SEQ ID NO: 36683 - DNA, 20 bp, Homo sapiens
cactgtgggttctgggttgg

SEQ ID NO: 36684 - DNA, 23 bp, Homo sapiens
cactgtgggttctgggttggggt

SEQ ID NO: 36685 - DNA, 24 bp, Homo sapiens
cactgtgggttctgggttggggtg

SEQ ID NO: 36686 - DNA, 25 bp, Homo sapiens
cactgtgggttctgggttggggtga

SEQ ID NO: 36687 - DNA, 26 bp, Homo sapiens
cactgtgggttctgggttggggtgat

SEQ ID NO: 36688 - DNA, 27 bp, Homo sapiens
cactgtgggttctgggttggggtgata

SEQ ID NO: 36689 - DNA, 20 bp, Homo sapiens
actgtgggttctgggttggg

SEQ ID NO: 36690 - DNA, 21 bp, Homo sapiens
actgtgggttctgggttgggg

SEQ ID NO: 36691 - DNA, 22 bp, Homo sapiens
actgtgggttctgggttggggt

SEQ ID NO: 36692 - DNA, 23 bp, Homo sapiens
actgtgggttctgggttggggtg

SEQ ID NO: 36693 - DNA, 24 bp, Homo sapiens
actgtgggttctgggttggggtga

SEQ ID NO: 36694 - DNA, 25 bp, Homo sapiens
actgtgggttctgggttggggtgat

SEQ ID NO: 36695 - DNA, 26 bp, Homo sapiens
actgtgggttctgggttggggtgata

SEQ ID NO: 36696 - DNA, 23 bp, Homo sapiens
ctgtgggttctgggttggggtga

SEQ ID NO: 36697 - DNA, 25 bp, Homo sapiens
ctgtgggttctgggttggggtgata

SEQ ID NO: 36698 - DNA, 21 bp, Homo sapiens
tgtgggttctgggttggggtg

SEQ ID NO: 36699 - DNA, 21 bp, Homo sapiens
tccccaacccctgcccgcaga

SEQ ID NO: 36700 - DNA, 22 bp, Homo sapiens
tccccaacccctgcccgcagac

SEQ ID NO: 36701 - DNA, 23 bp, Homo sapiens
tccccaacccctgcccgcagacg

SEQ ID NO: 36702 - DNA, 20 bp, Homo sapiens
ccccaacccctgcccgcaga

SEQ ID NO: 36703 - DNA, 21 bp, Homo sapiens
ccccaacccctgcccgcagac

SEQ ID NO: 36704 - DNA, 21 bp, Homo sapiens
tggcccgcaggtgagatgagg

SEQ ID NO: 36705 - DNA, 21 bp, Homo sapiens
gcccgcaggtgagatgagggc

SEQ ID NO: 36706 - DNA, 17 bp, Homo sapiens
cccgcaggtgagatgag

SEQ ID NO: 36707 - DNA, 18 bp, Homo sapiens
cccgcaggtgagatgagg

SEQ ID NO: 36708 - DNA, 19 bp, Homo sapiens
cccgcaggtgagatgaggg

SEQ ID NO: 36709 - DNA, 20 bp, Homo sapiens
cccgcaggtgagatgagggc

SEQ ID NO: 36710 - DNA, 22 bp, Homo sapiens
cccgcaggtgagatgagggctc

SEQ ID NO: 36711 - DNA, 23 bp, Homo sapiens
cccgcaggtgagatgagggctcc

SEQ ID NO: 36712 - DNA, 24 bp, Homo sapiens
cccgcaggtgagatgagggctcct

SEQ ID NO: 36713 - DNA, 25 bp, Homo sapiens
cccgcaggtgagatgagggctcctg

SEQ ID NO: 36714 - DNA, 26 bp, Homo sapiens
cccgcaggtgagatgagggctcctgg

SEQ ID NO: 36715 - DNA, 21 bp, Homo sapiens
ccgcaggtgagatgagggctc

SEQ ID NO: 36716 - DNA, 24 bp, Homo sapiens
atgcccttctctcctcctgcctca

SEQ ID NO: 36717 - DNA, 22 bp, Homo sapiens
tgcccttctctcctcctgcctc

SEQ ID NO: 36718 - DNA, 23 bp, Homo sapiens
tgcccttctctcctcctgcctca

SEQ ID NO: 36719 - DNA, 24 bp, Homo sapiens
tgcccttctctcctcctgcctcag

SEQ ID NO: 36720 - DNA, 25 bp, Homo sapiens
tgcccttctctcctcctgcctcagc

SEQ ID NO: 36721 - DNA, 21 bp, Homo sapiens
ccttctctcctcctgcctcag

SEQ ID NO: 36722 - DNA, 22 bp, Homo sapiens
ccttctctcctcctgcctcagc

SEQ ID NO: 36723 - DNA, 25 bp, Homo sapiens
aggctgtgatgctctcctgagccct

SEQ ID NO: 36724 - DNA, 26 bp, Homo sapiens
taggctgtgatgctctcctgagccct

SEQ ID NO: 36725 - DNA, 23 bp, Homo sapiens
ggctgtgatgctctcctgagccc

SEQ ID NO: 36726 - DNA, 23 bp, Homo sapiens
aggctgtgatgctctcctgagcc

SEQ ID NO: 36727 - DNA, 22 bp, Homo sapiens
aggctgtgatgctctcctgagc

SEQ ID NO: 36728 - DNA, 20 bp, Homo sapiens
aggctgtgatgctctcctga

SEQ ID NO: 36729 - DNA, 19 bp, Homo sapiens
aggctgtgatgctctcctg

SEQ ID NO: 36730 - DNA, 18 bp, Homo sapiens
cttcataggctgtgatgc

SEQ ID NO: 36731 - DNA, 21 bp, Homo sapiens
tagctgaactctagcctgagc

SEQ ID NO: 36732 - DNA, 22 bp, Homo sapiens
tagctgaactctagcctgagca

SEQ ID NO: 36733 - DNA, 23 bp, Homo sapiens
tagctgaactctagcctgagcaa

SEQ ID NO: 36734 - DNA, 24 bp, Homo sapiens
tagctgaactctagcctgagcaac

SEQ ID NO: 36735 - DNA, 20 bp, Homo sapiens
agctgaactctagcctgagc

SEQ ID NO: 36736 - DNA, 21 bp, Homo sapiens
agctgaactctagcctgagca

SEQ ID NO: 36737 - DNA, 22 bp, Homo sapiens
agctgaactctagcctgagcaa

SEQ ID NO: 36738 - DNA, 23 bp, Homo sapiens
agctgaactctagcctgagcaac

SEQ ID NO: 36739 - DNA, 27 bp, Homo sapiens
ctgaactctagcctgagcaacagagtg

SEQ ID NO: 36740 - DNA, 16 bp, Homo sapiens
tgggcgcagggggact

SEQ ID NO: 36741 - DNA, 18 bp, Homo sapiens
cgcagggggactgggggt

SEQ ID NO: 36742 - DNA, 22 bp, Homo sapiens
cgcagggggactgggggtgagc

SEQ ID NO: 36743 - DNA, 19 bp, Homo sapiens
gcagggggactgggggtga

SEQ ID NO: 36744 - DNA, 21 bp, Homo sapiens
gcagggggactgggggtgagc

SEQ ID NO: 36745 - DNA, 19 bp, Homo sapiens
cagggggactgggggtgag

SEQ ID NO: 36746 - DNA, 21 bp, Homo sapiens
cagggggactgggggtgagca

SEQ ID NO: 36747 - DNA, 22 bp, Homo sapiens
cagggggactgggggtgagcag

SEQ ID NO: 36748 - DNA, 22 bp, Homo sapiens
ggggactgggggtgagcaggcc

SEQ ID NO: 36749 - DNA, 23 bp, Homo sapiens
ggggactgggggtgagcaggccc

SEQ ID NO: 36750 - DNA, 20 bp, Homo sapiens
ggactgggggtgagcaggcc

SEQ ID NO: 36751 - DNA, 20 bp, Homo sapiens
cgtgctcactctcagtccct

SEQ ID NO: 36752 - DNA, 21 bp, Homo sapiens
cgtgctcactctcagtccctc

SEQ ID NO: 36753 - DNA, 22 bp, Homo sapiens
cgtgctcactctcagtccctcc

SEQ ID NO: 36754 - DNA, 18 bp, Homo sapiens
tgctcactctcagtccct

SEQ ID NO: 36755 - DNA, 21 bp, Homo sapiens
tgctcactctcagtccctccc

SEQ ID NO: 36756 - DNA, 22 bp, Homo sapiens
tgctcactctcagtccctccct

SEQ ID NO: 36757 - DNA, 23 bp, Homo sapiens
tgctcactctcagtccctcccta

SEQ ID NO: 36758 - DNA, 24 bp, Homo sapiens
tgctcactctcagtccctccctag

SEQ ID NO: 36759 - DNA, 25 bp, Homo sapiens
tgctcactctcagtccctccctaga

SEQ ID NO: 36760 - DNA, 18 bp, Homo sapiens
ctcactctcagtccctcc

SEQ ID NO: 36761 - DNA, 22 bp, Homo sapiens
ctcactctcagtccctccctag

SEQ ID NO: 36762 - DNA, 23 bp, Homo sapiens
ctcactctcagtccctccctaga

SEQ ID NO: 36763 - DNA, 24 bp, Homo sapiens
ctcactctcagtccctccctagat

SEQ ID NO: 36764 - DNA, 20 bp, Homo sapiens
gactccaagaagaatctaga

SEQ ID NO: 36765 - DNA, 21 bp, Homo sapiens
gactccaagaagaatctagac

SEQ ID NO: 36766 - DNA, 22 bp, Homo sapiens
gactccaagaagaatctagaca

SEQ ID NO: 36767 - DNA, 23 bp, Homo sapiens
gactccaagaagaatctagacag

SEQ ID NO: 36768 - DNA, 24 bp, Homo sapiens
gactccaagaagaatctagacaga

SEQ ID NO: 36769 - DNA, 26 bp, Homo sapiens
gactccaagaagaatctagacagata

SEQ ID NO: 36770 - DNA, 19 bp, Homo sapiens
actccaagaagaatctaga

SEQ ID NO: 36771 - DNA, 20 bp, Homo sapiens
actccaagaagaatctagac

SEQ ID NO: 36772 - DNA, 21 bp, Homo sapiens
actccaagaagaatctagaca

SEQ ID NO: 36773 - DNA, 23 bp, Homo sapiens
actccaagaagaatctagacaga

SEQ ID NO: 36774 - DNA, 24 bp, Homo sapiens
actccaagaagaatctagacagat

SEQ ID NO: 36775 - DNA, 25 bp, Homo sapiens
actccaagaagaatctagacagata

SEQ ID NO: 36776 - DNA, 20 bp, Homo sapiens
ctccaagaagaatctagaca

SEQ ID NO: 36777 - DNA, 21 bp, Homo sapiens
ctccaagaagaatctagacag

SEQ ID NO: 36778 - DNA, 22 bp, Homo sapiens
ctccaagaagaatctagacaga

SEQ ID NO: 36779 - DNA, 24 bp, Homo sapiens
ctccaagaagaatctagacagata

SEQ ID NO: 36780 - DNA, 19 bp, Homo sapiens
agaatctagacagataggc

SEQ ID NO: 36781 - DNA, 18 bp, Homo sapiens
gaatctagacagataggc

SEQ ID NO: 36782 - DNA, 19 bp, Homo sapiens
cattggagggtgtggaaga

SEQ ID NO: 36783 - DNA, 22 bp, Homo sapiens
attggagggtgtggaagacatc

SEQ ID NO: 36784 - DNA, 23 bp, Homo sapiens
attggagggtgtggaagacatct

SEQ ID NO: 36785 - DNA, 18 bp, Homo sapiens
ttggagggtgtggaagac

SEQ ID NO: 36786 - DNA, 19 bp, Homo sapiens
ttggagggtgtggaagaca

SEQ ID NO: 36787 - DNA, 20 bp, Homo sapiens
ttggagggtgtggaagacat

SEQ ID NO: 36788 - DNA, 22 bp, Homo sapiens
ttggagggtgtggaagacatct

SEQ ID NO: 36789 - DNA, 23 bp, Homo sapiens
ttggagggtgtggaagacatctg

SEQ ID NO: 36790 - DNA, 24 bp, Homo sapiens
ttggagggtgtggaagacatctgg

SEQ ID NO: 36791 - DNA, 26 bp, Homo sapiens
ttggagggtgtggaagacatctgggc

SEQ ID NO: 36792 - DNA, 20 bp, Homo sapiens
tggagggtgtggaagacatc

SEQ ID NO: 36793 - DNA, 17 bp, Homo sapiens
tggaagacatctgggcc

SEQ ID NO: 36794 - DNA, 16 bp, Homo sapiens
ctctgatctcttcatc

SEQ ID NO: 36795 - DNA, 21 bp, Homo sapiens
ctctgatctcttcatctaccc

SEQ ID NO: 36796 - DNA, 26 bp, Homo sapiens
ctctgatctcttcatctaccccccag

SEQ ID NO: 36797 - DNA, 24 bp, Homo sapiens
tctgatctcttcatctacccccca

SEQ ID NO: 36798 - DNA, 22 bp, Homo sapiens
tgatctcttcatctacccccca

SEQ ID NO: 36799 - DNA, 24 bp, Homo sapiens
tgatctcttcatctaccccccagg

SEQ ID NO: 36800 - DNA, 23 bp, Homo sapiens
gatctcttcatctaccccccagg

SEQ ID NO: 36801 - DNA, 21 bp, Homo sapiens
tctcttcatctaccccccagg

SEQ ID NO: 36802 - DNA, 22 bp, Homo sapiens
tctcttcatctaccccccagga

SEQ ID NO: 36803 - DNA, 23 bp, Homo sapiens
tctcttcatctaccccccaggac

SEQ ID NO: 36804 - DNA, 25 bp, Homo sapiens
gctcagttcagcaggaacaggggtc

SEQ ID NO: 36805 - DNA, 27 bp, Homo sapiens
tggctcagttcagcaggaacaggggtc

SEQ ID NO: 36806 - DNA, 26 bp, Homo sapiens
tggctcagttcagcaggaacaggggt

SEQ ID NO: 36807 - DNA, 25 bp, Homo sapiens
tggctcagttcagcaggaacagggg

SEQ ID NO: 36808 - DNA, 22 bp, Homo sapiens
gctcagttcagcaggaacaggg

SEQ ID NO: 36809 - DNA, 23 bp, Homo sapiens
ggctcagttcagcaggaacaggg

SEQ ID NO: 36810 - DNA, 24 bp, Homo sapiens
tggctcagttcagcaggaacaggg

SEQ ID NO: 36811 - DNA, 25 bp, Homo sapiens
tacactggctcagttcagcaggaac

SEQ ID NO: 36812 - DNA, 24 bp, Homo sapiens
tacactggctcagttcagcaggaa

SEQ ID NO: 36813 - DNA, 18 bp, Homo sapiens
tggctcagttcagcagga

SEQ ID NO: 36814 - DNA, 23 bp, Homo sapiens
tacactggctcagttcagcagga

SEQ ID NO: 36815 - DNA, 20 bp, Homo sapiens
gtacactggctcagttcagc

SEQ ID NO: 36816 - DNA, 17 bp, Homo sapiens
gtacactggctcagttc

SEQ ID NO: 36817 - DNA, 25 bp, Homo sapiens
gtgcctactgagctgaaacacagtt

SEQ ID NO: 36818 - DNA, 23 bp, Homo sapiens
tgcctactgagctgaaacacagt

SEQ ID NO: 36819 - DNA, 24 bp, Homo sapiens
gtgcctactgagctgaaacacagt

SEQ ID NO: 36820 - DNA, 23 bp, Homo sapiens
gtgcctactgagctgaaacacag

SEQ ID NO: 36821 - DNA, 22 bp, Homo sapiens
gtgcctactgagctgaaacaca

SEQ ID NO: 36822 - DNA, 23 bp, Homo sapiens
cgtgcctactgagctgaaacaca

SEQ ID NO: 36823 - DNA, 21 bp, Homo sapiens
gtgcctactgagctgaaacac

SEQ ID NO: 36824 - DNA, 20 bp, Homo sapiens
gtgcctactgagctgaaaca

SEQ ID NO: 36825 - DNA, 19 bp, Homo sapiens
gtgcctactgagctgaaac

SEQ ID NO: 36826 - DNA, 23 bp, Homo sapiens
ttcacagtggctaagttccgccc

SEQ ID NO: 36827 - DNA, 22 bp, Homo sapiens
ttcacagtggctaagttccgcc

SEQ ID NO: 36828 - DNA, 20 bp, Homo sapiens
ttcacagtggctaagttccg

SEQ ID NO: 36829 - DNA, 19 bp, Homo sapiens
ttcacagtggctaagttcc

SEQ ID NO: 36830 - DNA, 23 bp, Homo sapiens
ttagctgcttgtgagcagggtcc

SEQ ID NO: 36831 - DNA, 27 bp, Homo sapiens
gggcttagctgcttgtgagcagggtcc

SEQ ID NO: 36832 - DNA, 26 bp, Homo sapiens
gggcttagctgcttgtgagcagggtc

SEQ ID NO: 36833 - DNA, 25 bp, Homo sapiens
gggcttagctgcttgtgagcagggt

SEQ ID NO: 36834 - DNA, 26 bp, Homo sapiens
agggcttagctgcttgtgagcagggt

SEQ ID NO: 36835 - DNA, 24 bp, Homo sapiens
gggcttagctgcttgtgagcaggg

SEQ ID NO: 36836 - DNA, 25 bp, Homo sapiens
agggcttagctgcttgtgagcaggg

SEQ ID NO: 36837 - DNA, 24 bp, Homo sapiens
agggcttagctgcttgtgagcagg

SEQ ID NO: 36838 - DNA, 23 bp, Homo sapiens
agggcttagctgcttgtgagcag

SEQ ID NO: 36839 - DNA, 21 bp, Homo sapiens
gggcttagctgcttgtgagca

SEQ ID NO: 36840 - DNA, 21 bp, Homo sapiens
agggcttagctgcttgtgagc

SEQ ID NO: 36841 - DNA, 20 bp, Homo sapiens
agggcttagctgcttgtgag

SEQ ID NO: 36842 - DNA, 19 bp, Homo sapiens
agggcttagctgcttgtga

SEQ ID NO: 36843 - DNA, 18 bp, Homo sapiens
agggcttagctgcttgtg

SEQ ID NO: 36844 - DNA, 17 bp, Homo sapiens
agggcttagctgcttgt

SEQ ID NO: 36845 - DNA, 25 bp, Homo sapiens
atcacattgccagggatttccaacc

SEQ ID NO: 36846 - DNA, 24 bp, Homo sapiens
atcacattgccagggatttccaac

SEQ ID NO: 36847 - DNA, 23 bp, Homo sapiens
atcacattgccagggatttccaa

SEQ ID NO: 36848 - DNA, 22 bp, Homo sapiens
atcacattgccagggatttcca

SEQ ID NO: 36849 - DNA, 20 bp, Homo sapiens
atcacattgccagggatttc

SEQ ID NO: 36850 - DNA, 19 bp, Homo sapiens
atcacattgccagggattt

SEQ ID NO: 36851 - DNA, 27 bp, Homo sapiens
ggggttcctggggatgggatttgcttc

SEQ ID NO: 36852 - DNA, 25 bp, Homo sapiens
ggggttcctggggatgggatttgct

SEQ ID NO: 36853 - DNA, 24 bp, Homo sapiens
ggggttcctggggatgggatttgc

SEQ ID NO: 36854 - DNA, 23 bp, Homo sapiens
ggggttcctggggatgggatttg

SEQ ID NO: 36855 - DNA, 24 bp, Homo sapiens
tggggttcctggggatgggatttg

SEQ ID NO: 36856 - DNA, 21 bp, Homo sapiens
gggttcctggggatgggattt

SEQ ID NO: 36857 - DNA, 21 bp, Homo sapiens
ggggttcctggggatgggatt

SEQ ID NO: 36858 - DNA, 22 bp, Homo sapiens
tggggttcctggggatgggatt

SEQ ID NO: 36859 - DNA, 20 bp, Homo sapiens
ggggttcctggggatgggat

SEQ ID NO: 36860 - DNA, 21 bp, Homo sapiens
tggggttcctggggatgggat

SEQ ID NO: 36861 - DNA, 19 bp, Homo sapiens
ggggttcctggggatggga

SEQ ID NO: 36862 - DNA, 17 bp, Homo sapiens
aacattcaacctgtcgg

SEQ ID NO: 36863 - DNA, 19 bp, Homo sapiens
aacattcaacctgtcggtg

SEQ ID NO: 36864 - DNA, 20 bp, Homo sapiens
aacattcaacctgtcggtga

SEQ ID NO: 36865 - DNA, 21 bp, Homo sapiens
aacattcaacctgtcggtgag

SEQ ID NO: 36866 - DNA, 23 bp, Homo sapiens
aacattcaacctgtcggtgagtt

SEQ ID NO: 36867 - DNA, 24 bp, Homo sapiens
aacattcaacctgtcggtgagttt

SEQ ID NO: 36868 - DNA, 25 bp, Homo sapiens
aacattcaacctgtcggtgagtttg

SEQ ID NO: 36869 - DNA, 23 bp, Homo sapiens
aaccatcgaccgttgagtggacc

SEQ ID NO: 36870 - DNA, 16 bp, Homo sapiens
accatcgaccgttgag

SEQ ID NO: 36871 - DNA, 17 bp, Homo sapiens
accatcgaccgttgagt

SEQ ID NO: 36872 - DNA, 18 bp, Homo sapiens
accatcgaccgttgagtg

SEQ ID NO: 36873 - DNA, 19 bp, Homo sapiens
accatcgaccgttgagtgg

SEQ ID NO: 36874 - DNA, 20 bp, Homo sapiens
accatcgaccgttgagtgga

SEQ ID NO: 36875 - DNA, 21 bp, Homo sapiens
accatcgaccgttgagtggac

SEQ ID NO: 36876 - DNA, 22 bp, Homo sapiens
accatcgaccgttgagtggacc

SEQ ID NO: 36877 - DNA, 23 bp, Homo sapiens
accatcgaccgttgagtggaccc

SEQ ID NO: 36878 - DNA, 24 bp, Homo sapiens
accatcgaccgttgagtggaccct

SEQ ID NO: 36879 - DNA, 18 bp, Homo sapiens
aacattcattgttgtcgg

SEQ ID NO: 36880 - DNA, 19 bp, Homo sapiens
aacattcattgttgtcggt

SEQ ID NO: 36881 - DNA, 20 bp, Homo sapiens
aacattcattgttgtcggtg

SEQ ID NO: 36882 - DNA, 21 bp, Homo sapiens
aacattcattgttgtcggtgg

SEQ ID NO: 36883 - DNA, 22 bp, Homo sapiens
aacattcattgttgtcggtggg

SEQ ID NO: 36884 - DNA, 24 bp, Homo sapiens
aacattcattgttgtcggtgggtt

SEQ ID NO: 36885 - DNA, 25 bp, Homo sapiens
aacattcattgttgtcggtgggttg

SEQ ID NO: 36886 - DNA, 26 bp, Homo sapiens
aacattcattgttgtcggtgggttgt

SEQ ID NO: 36887 - DNA, 28 bp, Homo sapiens
aacattcattgttgtcggtgggttgtga

SEQ ID NO: 36888 - DNA, 20 bp, Homo sapiens
ccagacccaccgggggatga

SEQ ID NO: 36889 - DNA, 18 bp, Homo sapiens
acccaccgggggatgaat

SEQ ID NO: 36890 - DNA, 20 bp, Homo sapiens
acccaccgggggatgaatgt

SEQ ID NO: 36891 - DNA, 21 bp, Homo sapiens
acccaccgggggatgaatgtc

SEQ ID NO: 36892 - DNA, 22 bp, Homo sapiens
acccaccgggggatgaatgtca

SEQ ID NO: 36893 - DNA, 24 bp, Homo sapiens
acccaccgggggatgaatgtcact

SEQ ID NO: 36894 - DNA, 21 bp, Homo sapiens
cccaccgggggatgaatgtca

SEQ ID NO: 36895 - DNA, 18 bp, Homo sapiens
ccaccgggggatgaatgt

SEQ ID NO: 36896 - DNA, 19 bp, Homo sapiens
ccaccgggggatgaatgtc

SEQ ID NO: 36897 - DNA, 20 bp, Homo sapiens
ccaccgggggatgaatgtca

SEQ ID NO: 36898 - DNA, 22 bp, Homo sapiens
ccaccgggggatgaatgtcact

SEQ ID NO: 36899 - DNA, 19 bp, Homo sapiens
tgagcccgggccgcgcagg

SEQ ID NO: 36900 - DNA, 19 bp, Homo sapiens
gagcccgggccgcgcaggc

SEQ ID NO: 36901 - DNA, 20 bp, Homo sapiens
tgcgcgtgcggccggtgctc

SEQ ID NO: 36902 - DNA, 17 bp, Homo sapiens
tagtctatcgctgcggt

SEQ ID NO: 36903 - DNA, 24 bp, Homo sapiens
cgctgcggttgcgagcgctgtagg

SEQ ID NO: 36904 - DNA, 16 bp, Homo sapiens
gctgcggttgcgagcg

SEQ ID NO: 36905 - DNA, 25 bp, Homo sapiens
ctgcggttgcgagcgctgtagggag

SEQ ID NO: 36906 - DNA, 21 bp, Homo sapiens
tgcggttgcgagcgctgtagg

SEQ ID NO: 36907 - DNA, 22 bp, Homo sapiens
cggttgcgagcgctgtagggag

SEQ ID NO: 36908 - DNA, 19 bp, Homo sapiens
gttgcgagcgctgtaggga

SEQ ID NO: 36909 - DNA, 20 bp, Homo sapiens
gttgcgagcgctgtagggag

SEQ ID NO: 36910 - DNA, 18 bp, Homo sapiens
ttgcgagcgctgtaggga

SEQ ID NO: 36911 - DNA, 18 bp, Homo sapiens
tgcgagcgctgtagggag

SEQ ID NO: 36912 - DNA, 17 bp, Homo sapiens
gcgagcgctgtagggag

SEQ ID NO: 36913 - DNA, 16 bp, Homo sapiens
cgagcgctgtagggag

SEQ ID NO: 36914 - DNA, 24 bp, Homo sapiens
acccctcgtttcttcccccagggg

SEQ ID NO: 36915 - DNA, 23 bp, Homo sapiens
acccctcgtttcttcccccaggg

SEQ ID NO: 36916 - DNA, 25 bp, Homo sapiens
ccacccctcgtttcttcccccaggg

SEQ ID NO: 36917 - DNA, 22 bp, Homo sapiens
acccctcgtttcttcccccagg

SEQ ID NO: 36918 - DNA, 23 bp, Homo sapiens
cacccctcgtttcttcccccagg

SEQ ID NO: 36919 - DNA, 24 bp, Homo sapiens
ccacccctcgtttcttcccccagg

SEQ ID NO: 36920 - DNA, 23 bp, Homo sapiens
ccacccctcgtttcttcccccag

SEQ ID NO: 36921 - DNA, 20 bp, Homo sapiens
acccctcgtttcttccccca

SEQ ID NO: 36922 - DNA, 18 bp, Homo sapiens
acccctcgtttcttcccc

SEQ ID NO: 36923 - DNA, 19 bp, Homo sapiens
gatgagaggctgtcttcat

SEQ ID NO: 36924 - DNA, 24 bp, Homo sapiens
ggggggacaggatgagaggctgtc

SEQ ID NO: 36925 - DNA, 25 bp, Homo sapiens
tggggggacaggatgagaggctgtc

SEQ ID NO: 36926 - DNA, 26 bp, Homo sapiens
ttggggggacaggatgagaggctgtc

SEQ ID NO: 36927 - DNA, 24 bp, Homo sapiens
ttggggggacaggatgagaggctg

SEQ ID NO: 36928 - DNA, 21 bp, Homo sapiens
ggggggacaggatgagaggct

SEQ ID NO: 36929 - DNA, 23 bp, Homo sapiens
ttggggggacaggatgagaggct

SEQ ID NO: 36930 - DNA, 22 bp, Homo sapiens
ttggggggacaggatgagaggc

SEQ ID NO: 36931 - DNA, 20 bp, Homo sapiens
tggggggacaggatgagagg

SEQ ID NO: 36932 - DNA, 21 bp, Homo sapiens
ttggggggacaggatgagagg

SEQ ID NO: 36933 - DNA, 19 bp, Homo sapiens
ttggggggacaggatgaga

SEQ ID NO: 36934 - DNA, 18 bp, Homo sapiens
cagggttggggggacagg

SEQ ID NO: 36935 - DNA, 24 bp, Homo sapiens
caggggccgggtgctcaccgcatc

SEQ ID NO: 36936 - DNA, 25 bp, Homo sapiens
cgcaggggccgggtgctcaccgcat

SEQ ID NO: 36937 - DNA, 24 bp, Homo sapiens
cgcaggggccgggtgctcaccgca

SEQ ID NO: 36938 - DNA, 23 bp, Homo sapiens
cgcaggggccgggtgctcaccgc

SEQ ID NO: 36939 - DNA, 24 bp, Homo sapiens
gcgcaggggccgggtgctcaccgc

SEQ ID NO: 36940 - DNA, 23 bp, Homo sapiens
gcgcaggggccgggtgctcaccg

SEQ ID NO: 36941 - DNA, 21 bp, Homo sapiens
cgcaggggccgggtgctcacc

SEQ ID NO: 36942 - DNA, 23 bp, Homo sapiens
tgcgcaggggccgggtgctcacc

SEQ ID NO: 36943 - DNA, 19 bp, Homo sapiens
cgcaggggccgggtgctca

SEQ ID NO: 36944 - DNA, 17 bp, Homo sapiens
cgcaggggccgggtgct

SEQ ID NO: 36945 - DNA, 16 bp, Homo sapiens
cgcaggggccgggtgc

SEQ ID NO: 36946 - DNA, 25 bp, Homo sapiens
gtgagtgccggtgcctgccctgggg

SEQ ID NO: 36947 - DNA, 24 bp, Homo sapiens
gtgagtgccggtgcctgccctggg

SEQ ID NO: 36948 - DNA, 22 bp, Homo sapiens
tgagtgccggtgcctgccctgg

SEQ ID NO: 36949 - DNA, 23 bp, Homo sapiens
gtgagtgccggtgcctgccctgg

SEQ ID NO: 36950 - DNA, 22 bp, Homo sapiens
gtgagtgccggtgcctgccctg

SEQ ID NO: 36951 - DNA, 21 bp, Homo sapiens
gtgagtgccggtgcctgccct

SEQ ID NO: 36952 - DNA, 16 bp, Homo sapiens
tgagtgccggtgcctg

SEQ ID NO: 36953 - DNA, 17 bp, Homo sapiens
caatggtgagtgccggt

SEQ ID NO: 36954 - DNA, 17 bp, Homo sapiens
ttctggagaggctttgt

SEQ ID NO: 36955 - DNA, 18 bp, Homo sapiens
ttctggagaggctttgtg

SEQ ID NO: 36956 - DNA, 19 bp, Homo sapiens
ttctggagaggctttgtgc

SEQ ID NO: 36957 - DNA, 20 bp, Homo sapiens
ttctggagaggctttgtgcg

SEQ ID NO: 36958 - DNA, 17 bp, Homo sapiens
agaggctttgtgcggat

SEQ ID NO: 36959 - DNA, 19 bp, Homo sapiens
agaggctttgtgcggatac

SEQ ID NO: 36960 - DNA, 20 bp, Homo sapiens
agaggctttgtgcggatacg

SEQ ID NO: 36961 - DNA, 21 bp, Homo sapiens
agaggctttgtgcggatacgg

SEQ ID NO: 36962 - DNA, 22 bp, Homo sapiens
agaggctttgtgcggatacggg

SEQ ID NO: 36963 - DNA, 24 bp, Homo sapiens
agaggctttgtgcggatacggggc

SEQ ID NO: 36964 - DNA, 20 bp, Homo sapiens
ggctttgtgcggatacgggg

SEQ ID NO: 36965 - DNA, 26 bp, Homo sapiens
ggctttgtgcggatacggggctggag

SEQ ID NO: 36966 - DNA, 20 bp, Homo sapiens
gctttgtgcggatacggggc

SEQ ID NO: 36967 - DNA, 16 bp, Homo sapiens
ggatacggggctggag

SEQ ID NO: 36968 - DNA, 21 bp, Homo sapiens
tgccccatctgtgccctgggt

SEQ ID NO: 36969 - DNA, 23 bp, Homo sapiens
tgccccatctgtgccctgggtag

SEQ ID NO: 36970 - DNA, 24 bp, Homo sapiens
tgccccatctgtgccctgggtagg

SEQ ID NO: 36971 - DNA, 26 bp, Homo sapiens
tgccccatctgtgccctgggtaggaa

SEQ ID NO: 36972 - DNA, 20 bp, Homo sapiens
cccttgggtctgatggggta

SEQ ID NO: 36973 - DNA, 22 bp, Homo sapiens
cccttgggtctgatggggtagc

SEQ ID NO: 36974 - DNA, 23 bp, Homo sapiens
cccttgggtctgatggggtagcc

SEQ ID NO: 36975 - DNA, 24 bp, Homo sapiens
cccttgggtctgatggggtagccg

SEQ ID NO: 36976 - DNA, 20 bp, Homo sapiens
gggcatgatccaggaacctg

SEQ ID NO: 36977 - DNA, 20 bp, Homo sapiens
tgatccaggaacctgcctct

SEQ ID NO: 36978 - DNA, 19 bp, Homo sapiens
gatccaggaacctgcctct

SEQ ID NO: 36979 - DNA, 18 bp, Homo sapiens
atccaggaacctgcctct

SEQ ID NO: 36980 - DNA, 25 bp, Homo sapiens
atcagcaagtatactgccctagaag

SEQ ID NO: 36981 - DNA, 24 bp, Homo sapiens
atcagcaagtatactgccctagaa

SEQ ID NO: 36982 - DNA, 25 bp, Homo sapiens
aatcagcaagtatactgccctagaa

SEQ ID NO: 36983 - DNA, 26 bp, Homo sapiens
caatcagcaagtatactgccctagaa

SEQ ID NO: 36984 - DNA, 22 bp, Homo sapiens
atcagcaagtatactgccctag

SEQ ID NO: 36985 - DNA, 23 bp, Homo sapiens
aatcagcaagtatactgccctag

SEQ ID NO: 36986 - DNA, 24 bp, Homo sapiens
caatcagcaagtatactgccctag

SEQ ID NO: 36987 - DNA, 22 bp, Homo sapiens
aatcagcaagtatactgcccta

SEQ ID NO: 36988 - DNA, 23 bp, Homo sapiens
caatcagcaagtatactgcccta

SEQ ID NO: 36989 - DNA, 20 bp, Homo sapiens
atcagcaagtatactgccct

SEQ ID NO: 36990 - DNA, 21 bp, Homo sapiens
aatcagcaagtatactgccct

SEQ ID NO: 36991 - DNA, 20 bp, Homo sapiens
aatcagcaagtatactgccc

SEQ ID NO: 36992 - DNA, 19 bp, Homo sapiens
aatcagcaagtatactgcc

SEQ ID NO: 36993 - DNA, 18 bp, Homo sapiens
aatcagcaagtatactgc

SEQ ID NO: 36994 - DNA, 27 bp, Homo sapiens
tggcagtgtcttagctggttgttgtga

SEQ ID NO: 36995 - DNA, 25 bp, Homo sapiens
tggcagtgtcttagctggttgttgt

SEQ ID NO: 36996 - DNA, 24 bp, Homo sapiens
tggcagtgtcttagctggttgttg

SEQ ID NO: 36997 - DNA, 23 bp, Homo sapiens
tggcagtgtcttagctggttgtt

SEQ ID NO: 36998 - DNA, 21 bp, Homo sapiens
tggcagtgtcttagctggttg

SEQ ID NO: 36999 - DNA, 20 bp, Homo sapiens
tggcagtgtcttagctggtt

SEQ ID NO: 37000 - DNA, 19 bp, Homo sapiens
tggcagtgtcttagctggt

SEQ ID NO: 37001 - DNA, 18 bp, Homo sapiens
tggcagtgtcttagctgg

SEQ ID NO: 37002 - DNA, 23 bp, Homo sapiens
cgtgccacccttttccccagcta

SEQ ID NO: 37003 - DNA, 21 bp, Homo sapiens
gtgccacccttttccccagct

SEQ ID NO: 37004 - DNA, 22 bp, Homo sapiens
cgtgccacccttttccccagct

SEQ ID NO: 37005 - DNA, 20 bp, Homo sapiens
gtgccacccttttccccagc

SEQ ID NO: 37006 - DNA, 21 bp, Homo sapiens
cgtgccacccttttccccagc

SEQ ID NO: 37007 - DNA, 18 bp, Homo sapiens
cgtgccacccttttcccc

SEQ ID NO: 37008 - DNA, 17 bp, Homo sapiens
cgtgccacccttttccc

SEQ ID NO: 37009 - DNA, 20 bp, Homo sapiens
gggccaggcggtggtgggca

SEQ ID NO: 37010 - DNA, 23 bp, Homo sapiens
gtggggccaggcggtggtgggca

SEQ ID NO: 37011 - DNA, 25 bp, Homo sapiens
cggcgcccgtgtctcctccagcccg

SEQ ID NO: 37012 - DNA, 24 bp, Homo sapiens
cggcgcccgtgtctcctccagccc

SEQ ID NO: 37013 - DNA, 23 bp, Homo sapiens
cggcgcccgtgtctcctccagcc

SEQ ID NO: 37014 - DNA, 22 bp, Homo sapiens
cggcgcccgtgtctcctccagc

SEQ ID NO: 37015 - DNA, 25 bp, Homo sapiens
gtcccggcgcccgtgtctcctccag

SEQ ID NO: 37016 - DNA, 19 bp, Homo sapiens
ggcgcccgtgtctcctcca

SEQ ID NO: 37017 - DNA, 20 bp, Homo sapiens
cggcgcccgtgtctcctcca

SEQ ID NO: 37018 - DNA, 23 bp, Homo sapiens
gtcccggcgcccgtgtctcctcc

SEQ ID NO: 37019 - DNA, 25 bp, Homo sapiens
ccgtcccggcgcccgtgtctcctcc

SEQ ID NO: 37020 - DNA, 17 bp, Homo sapiens
cggcgcccgtgtctcct

SEQ ID NO: 37021 - DNA, 20 bp, Homo sapiens
tcccggcgcccgtgtctcct

SEQ ID NO: 37022 - DNA, 27 bp, Homo sapiens
taggggcgtcccgggcgcgcgggcggg

SEQ ID NO: 37023 - DNA, 26 bp, Homo sapiens
taggggcgtcccgggcgcgcgggcgg

SEQ ID NO: 37024 - DNA, 27 bp, Homo sapiens
gtaggggcgtcccgggcgcgcgggcgg

SEQ ID NO: 37025 - DNA, 19 bp, Homo sapiens
cgtcccgggcgcgcgggcg

SEQ ID NO: 37026 - DNA, 25 bp, Homo sapiens
taggggcgtcccgggcgcgcgggcg

SEQ ID NO: 37027 - DNA, 26 bp, Homo sapiens
gtaggggcgtcccgggcgcgcgggcg

SEQ ID NO: 37028 - DNA, 24 bp, Homo sapiens
taggggcgtcccgggcgcgcgggc

SEQ ID NO: 37029 - DNA, 25 bp, Homo sapiens
gtaggggcgtcccgggcgcgcgggc

SEQ ID NO: 37030 - DNA, 23 bp, Homo sapiens
taggggcgtcccgggcgcgcggg

SEQ ID NO: 37031 - DNA, 23 bp, Homo sapiens
gtaggggcgtcccgggcgcgcgg

SEQ ID NO: 37032 - DNA, 21 bp, Homo sapiens
gtaggggcgtcccgggcgcgc

SEQ ID NO: 37033 - DNA, 20 bp, Homo sapiens
gtaggggcgtcccgggcgcg

SEQ ID NO: 37034 - DNA, 19 bp, Homo sapiens
gtaggggcgtcccgggcgc

SEQ ID NO: 37035 - DNA, 20 bp, Homo sapiens
ctggtgttagcggtggaccg

SEQ ID NO: 37036 - DNA, 22 bp, Homo sapiens
ctggtgttagcggtggaccgcc

SEQ ID NO: 37037 - DNA, 16 bp, Homo sapiens
ccgccctgcgggggcc

SEQ ID NO: 37038 - DNA, 23 bp, Homo sapiens
acccgcccgtctccccacagctg

SEQ ID NO: 37039 - DNA, 21 bp, Homo sapiens
cccgcccgtctccccacagct

SEQ ID NO: 37040 - DNA, 22 bp, Homo sapiens
acccgcccgtctccccacagct

SEQ ID NO: 37041 - DNA, 23 bp, Homo sapiens
cacccgcccgtctccccacagct

SEQ ID NO: 37042 - DNA, 21 bp, Homo sapiens
acccgcccgtctccccacagc

SEQ ID NO: 37043 - DNA, 22 bp, Homo sapiens
cacccgcccgtctccccacagc

SEQ ID NO: 37044 - DNA, 19 bp, Homo sapiens
cccgcccgtctccccacag

SEQ ID NO: 37045 - DNA, 25 bp, Homo sapiens
gtgtggccggcaggcgggtgggcgg

SEQ ID NO: 37046 - DNA, 24 bp, Homo sapiens
gtgtggccggcaggcgggtgggcg

SEQ ID NO: 37047 - DNA, 23 bp, Homo sapiens
gtgtggccggcaggcgggtgggc

SEQ ID NO: 37048 - DNA, 21 bp, Homo sapiens
tgtggccggcaggcgggtggg

SEQ ID NO: 37049 - DNA, 22 bp, Homo sapiens
gtgtggccggcaggcgggtggg

SEQ ID NO: 37050 - DNA, 20 bp, Homo sapiens
gtgtggccggcaggcgggtg

SEQ ID NO: 37051 - DNA, 18 bp, Homo sapiens
gtgtggccggcaggcggg

SEQ ID NO: 37052 - DNA, 22 bp, Homo sapiens
agtttggacatagtgtggctgg

SEQ ID NO: 37053 - DNA, 23 bp, Homo sapiens
agtttggacatagtgtggctggg

SEQ ID NO: 37054 - DNA, 19 bp, Homo sapiens
gtttggacatagtgtggct

SEQ ID NO: 37055 - DNA, 20 bp, Homo sapiens
gtttggacatagtgtggctg

SEQ ID NO: 37056 - DNA, 23 bp, Homo sapiens
gtttggacatagtgtggctgggt

SEQ ID NO: 37057 - DNA, 21 bp, Homo sapiens
tttggacatagtgtggctggg

SEQ ID NO: 37058 - DNA, 22 bp, Homo sapiens
tttggacatagtgtggctgggt

SEQ ID NO: 37059 - DNA, 23 bp, Homo sapiens
tttggacatagtgtggctgggtc

SEQ ID NO: 37060 - DNA, 25 bp, Homo sapiens
tttggacatagtgtggctgggtcct

SEQ ID NO: 37061 - DNA, 21 bp, Homo sapiens
aatggggggacagatggagag

SEQ ID NO: 37062 - DNA, 19 bp, Homo sapiens
atggggggacagatggaga

SEQ ID NO: 37063 - DNA, 20 bp, Homo sapiens
atggggggacagatggagag

SEQ ID NO: 37064 - DNA, 21 bp, Homo sapiens
atggggggacagatggagagg

SEQ ID NO: 37065 - DNA, 22 bp, Homo sapiens
atggggggacagatggagagga

SEQ ID NO: 37066 - DNA, 23 bp, Homo sapiens
atggggggacagatggagaggac

SEQ ID NO: 37067 - DNA, 24 bp, Homo sapiens
atggggggacagatggagaggaca

SEQ ID NO: 37068 - DNA, 25 bp, Homo sapiens
atggggggacagatggagaggacac

SEQ ID NO: 37069 - DNA, 22 bp, Homo sapiens
tggggggacagatggagaggac

SEQ ID NO: 37070 - DNA, 24 bp, Homo sapiens
tggggggacagatggagaggacac

SEQ ID NO: 37071 - DNA, 20 bp, Homo sapiens
tcccctccactttcctccta

SEQ ID NO: 37072 - DNA, 22 bp, Homo sapiens
tcccctccactttcctcctaga

SEQ ID NO: 37073 - DNA, 23 bp, Homo sapiens
tcccctccactttcctcctagac

SEQ ID NO: 37074 - DNA, 24 bp, Homo sapiens
tcccctccactttcctcctagact

SEQ ID NO: 37075 - DNA, 21 bp, Homo sapiens
cccctccactttcctcctaga

SEQ ID NO: 37076 - DNA, 22 bp, Homo sapiens
cccctccactttcctcctagac

SEQ ID NO: 37077 - DNA, 23 bp, Homo sapiens
ccagggaaggggacgagggttgg

SEQ ID NO: 37078 - DNA, 24 bp, Homo sapiens
ccagggaaggggacgagggttggg

SEQ ID NO: 37079 - DNA, 25 bp, Homo sapiens
ccagggaaggggacgagggttgggg

SEQ ID NO: 37080 - DNA, 22 bp, Homo sapiens
cagggaaggggacgagggttgg

SEQ ID NO: 37081 - DNA, 23 bp, Homo sapiens
cagggaaggggacgagggttggg

SEQ ID NO: 37082 - DNA, 24 bp, Homo sapiens
cagggaaggggacgagggttgggg

SEQ ID NO: 37083 - DNA, 25 bp, Homo sapiens
cagggaaggggacgagggttgggga

SEQ ID NO: 37084 - DNA, 23 bp, Homo sapiens
agggaaggggacgagggttgggg

SEQ ID NO: 37085 - DNA, 24 bp, Homo sapiens
agggaaggggacgagggttgggga

SEQ ID NO: 37086 - DNA, 23 bp, Homo sapiens
cttcatcctcgtctccctcccag

SEQ ID NO: 37087 - DNA, 20 bp, Homo sapiens
tcatcctcgtctccctccca

SEQ ID NO: 37088 - DNA, 22 bp, Homo sapiens
tcatcctcgtctccctcccagg

SEQ ID NO: 37089 - DNA, 23 bp, Homo sapiens
tcatcctcgtctccctcccaggt

SEQ ID NO: 37090 - DNA, 24 bp, Homo sapiens
tcatcctcgtctccctcccaggtt

SEQ ID NO: 37091 - DNA, 16 bp, Homo sapiens
ggctctgcgtctgcac

SEQ ID NO: 37092 - DNA, 21 bp, Homo sapiens
tttcgggctctgcgtctgcac

SEQ ID NO: 37093 - DNA, 23 bp, Homo sapiens
ctgagcactgggggctttcgggc

SEQ ID NO: 37094 - DNA, 18 bp, Homo sapiens
aggacgggagcgcggcgc

SEQ ID NO: 37095 - DNA, 22 bp, Homo sapiens
cagcaggacgggagcgcggcgc

SEQ ID NO: 37096 - DNA, 24 bp, Homo sapiens
cccagcaggacgggagcgcggcgc

SEQ ID NO: 37097 - DNA, 21 bp, Homo sapiens
cccagcaggacgggagcgcgg

SEQ ID NO: 37098 - DNA, 21 bp, Homo sapiens
gcccagcaggacgggagcgcg

SEQ ID NO: 37099 - DNA, 25 bp, Homo sapiens
aggagcccagcaggacgggagcgcg

SEQ ID NO: 37100 - DNA, 25 bp, Homo sapiens
aaggagcccagcaggacgggagcgc

SEQ ID NO: 37101 - DNA, 19 bp, Homo sapiens
gcccagcaggacgggagcg

SEQ ID NO: 37102 - DNA, 20 bp, Homo sapiens
agcccagcaggacgggagcg

SEQ ID NO: 37103 - DNA, 21 bp, Homo sapiens
gagcccagcaggacgggagcg

SEQ ID NO: 37104 - DNA, 20 bp, Homo sapiens
gagcccagcaggacgggagc

SEQ ID NO: 37105 - DNA, 18 bp, Homo sapiens
gagcccagcaggacggga

SEQ ID NO: 37106 - DNA, 16 bp, Homo sapiens
aaggagcccagcagga

SEQ ID NO: 37107 - DNA, 22 bp, Homo sapiens
catcagtgattctcctgctgct

SEQ ID NO: 37108 - DNA, 26 bp, Homo sapiens
tctgacatcagtgattctcctgctgc

SEQ ID NO: 37109 - DNA, 24 bp, Homo sapiens
tctgacatcagtgattctcctgct

SEQ ID NO: 37110 - DNA, 23 bp, Homo sapiens
tctgacatcagtgattctcctgc

SEQ ID NO: 37111 - DNA, 26 bp, Homo sapiens
agacataggatagagtcacctctgtc

SEQ ID NO: 37112 - DNA, 28 bp, Homo sapiens
aaagacataggatagagtcacctctgtc

SEQ ID NO: 37113 - DNA, 27 bp, Homo sapiens
aaagacataggatagagtcacctctgt

SEQ ID NO: 37114 - DNA, 26 bp, Homo sapiens
aaagacataggatagagtcacctctg

SEQ ID NO: 37115 - DNA, 24 bp, Homo sapiens
aagacataggatagagtcacctct

SEQ ID NO: 37116 - DNA, 25 bp, Homo sapiens
aaagacataggatagagtcacctct

SEQ ID NO: 37117 - DNA, 23 bp, Homo sapiens
aagacataggatagagtcacctc

SEQ ID NO: 37118 - DNA, 22 bp, Homo sapiens
aagacataggatagagtcacct

SEQ ID NO: 37119 - DNA, 23 bp, Homo sapiens
aaagacataggatagagtcacct

SEQ ID NO: 37120 - DNA, 24 bp, Homo sapiens
gaaagacataggatagagtcacct

SEQ ID NO: 37121 - DNA, 21 bp, Homo sapiens
aagacataggatagagtcacc

SEQ ID NO: 37122 - DNA, 22 bp, Homo sapiens
aaagacataggatagagtcacc

SEQ ID NO: 37123 - DNA, 21 bp, Homo sapiens
aaagacataggatagagtcac

SEQ ID NO: 37124 - DNA, 22 bp, Homo sapiens
gaaagacataggatagagtcac

SEQ ID NO: 37125 - DNA, 20 bp, Homo sapiens
aaagacataggatagagtca

SEQ ID NO: 37126 - DNA, 22 bp, Homo sapiens
cttgtggggttggagagctggc

SEQ ID NO: 37127 - DNA, 24 bp, Homo sapiens
cttgtggggttggagagctggctg

SEQ ID NO: 37128 - DNA, 25 bp, Homo sapiens
cttgtggggttggagagctggctgg

SEQ ID NO: 37129 - DNA, 26 bp, Homo sapiens
cttgtggggttggagagctggctggt

SEQ ID NO: 37130 - DNA, 20 bp, Homo sapiens
ttgtggggttggagagctgg

SEQ ID NO: 37131 - DNA, 21 bp, Homo sapiens
ttgtggggttggagagctggc

SEQ ID NO: 37132 - DNA, 22 bp, Homo sapiens
ttgtggggttggagagctggct

SEQ ID NO: 37133 - DNA, 24 bp, Homo sapiens
ttgtggggttggagagctggctgg

SEQ ID NO: 37134 - DNA, 25 bp, Homo sapiens
ttgtggggttggagagctggctggt

SEQ ID NO: 37135 - DNA, 26 bp, Homo sapiens
ttgtggggttggagagctggctggtc

SEQ ID NO: 37136 - DNA, 22 bp, Homo sapiens
tgtggggttggagagctggctg

SEQ ID NO: 37137 - DNA, 16 bp, Homo sapiens
gagctggctggtccag

SEQ ID NO: 37138 - DNA, 21 bp, Homo sapiens
agaagctctcccctccccgca

SEQ ID NO: 37139 - DNA, 23 bp, Homo sapiens
agaagctctcccctccccgcagg

SEQ ID NO: 37140 - DNA, 24 bp, Homo sapiens
agaagctctcccctccccgcaggg

SEQ ID NO: 37141 - DNA, 26 bp, Homo sapiens
agaagctctcccctccccgcagggtg

SEQ ID NO: 37142 - DNA, 18 bp, Homo sapiens
gaagctctcccctccccg

SEQ ID NO: 37143 - DNA, 19 bp, Homo sapiens
gaagctctcccctccccgc

SEQ ID NO: 37144 - DNA, 22 bp, Homo sapiens
gaagctctcccctccccgcagg

SEQ ID NO: 37145 - DNA, 23 bp, Homo sapiens
gaagctctcccctccccgcaggg

SEQ ID NO: 37146 - DNA, 25 bp, Homo sapiens
gaagctctcccctccccgcagggtg

SEQ ID NO: 37147 - DNA, 21 bp, Homo sapiens
ccaggagggaaggggctgaga

SEQ ID NO: 37148 - DNA, 21 bp, Homo sapiens
caggagggaaggggctgagaa

SEQ ID NO: 37149 - DNA, 25 bp, Homo sapiens
caggagggaaggggctgagaacagg

SEQ ID NO: 37150 - DNA, 26 bp, Homo sapiens
caggagggaaggggctgagaacagga

SEQ ID NO: 37151 - DNA, 28 bp, Homo sapiens
caggagggaaggggctgagaacaggacc

SEQ ID NO: 37152 - DNA, 20 bp, Homo sapiens
aggagggaaggggctgagaa

SEQ ID NO: 37153 - DNA, 21 bp, Homo sapiens
aggagggaaggggctgagaac

SEQ ID NO: 37154 - DNA, 22 bp, Homo sapiens
aggagggaaggggctgagaaca

SEQ ID NO: 37155 - DNA, 23 bp, Homo sapiens
aggagggaaggggctgagaacag

SEQ ID NO: 37156 - DNA, 21 bp, Homo sapiens
ctgcatgacccttccctcccc

SEQ ID NO: 37157 - DNA, 23 bp, Homo sapiens
ctgcatgacccttccctccccac

SEQ ID NO: 37158 - DNA, 24 bp, Homo sapiens
ctgcatgacccttccctccccaca

SEQ ID NO: 37159 - DNA, 25 bp, Homo sapiens
ctgcatgacccttccctccccacag

SEQ ID NO: 37160 - DNA, 20 bp, Homo sapiens
tgcatgacccttccctcccc

SEQ ID NO: 37161 - DNA, 21 bp, Homo sapiens
tgcatgacccttccctcccca

SEQ ID NO: 37162 - DNA, 23 bp, Homo sapiens
tgcatgacccttccctccccaca

SEQ ID NO: 37163 - DNA, 24 bp, Homo sapiens
tgcatgacccttccctccccacag

SEQ ID NO: 37164 - DNA, 25 bp, Homo sapiens
tgcatgacccttccctccccacagc

SEQ ID NO: 37165 - DNA, 17 bp, Homo sapiens
atgacccttccctcccc

SEQ ID NO: 37166 - DNA, 19 bp, Homo sapiens
cttccctccccacagcggc

SEQ ID NO: 37167 - DNA, 27 bp, Homo sapiens
ccaggcagccccacagcctcagacctc

SEQ ID NO: 37168 - DNA, 24 bp, Homo sapiens
caggcagccccacagcctcagacc

SEQ ID NO: 37169 - DNA, 19 bp, Homo sapiens
cagccccacagcctcagac

SEQ ID NO: 37170 - DNA, 23 bp, Homo sapiens
caggcagccccacagcctcagac

SEQ ID NO: 37171 - DNA, 21 bp, Homo sapiens
aggcagccccacagcctcaga

SEQ ID NO: 37172 - DNA, 22 bp, Homo sapiens
caggcagccccacagcctcaga

SEQ ID NO: 37173 - DNA, 21 bp, Homo sapiens
caggcagccccacagcctcag

SEQ ID NO: 37174 - DNA, 18 bp, Homo sapiens
gaaattcggctctgggtc

SEQ ID NO: 37175 - DNA, 18 bp, Homo sapiens
tcggctctgggtctgtgg

SEQ ID NO: 37176 - DNA, 21 bp, Homo sapiens
tcggctctgggtctgtgggga

SEQ ID NO: 37177 - DNA, 22 bp, Homo sapiens
tcggctctgggtctgtggggag

SEQ ID NO: 37178 - DNA, 23 bp, Homo sapiens
tcggctctgggtctgtggggagc

SEQ ID NO: 37179 - DNA, 24 bp, Homo sapiens
tcggctctgggtctgtggggagcg

SEQ ID NO: 37180 - DNA, 16 bp, Homo sapiens
cggctctgggtctgtg

SEQ ID NO: 37181 - DNA, 17 bp, Homo sapiens
cggctctgggtctgtgg

SEQ ID NO: 37182 - DNA, 18 bp, Homo sapiens
cggctctgggtctgtggg

SEQ ID NO: 37183 - DNA, 19 bp, Homo sapiens
cggctctgggtctgtgggg

SEQ ID NO: 37184 - DNA, 21 bp, Homo sapiens
cggctctgggtctgtggggag

SEQ ID NO: 37185 - DNA, 22 bp, Homo sapiens
cggctctgggtctgtggggagc

SEQ ID NO: 37186 - DNA, 23 bp, Homo sapiens
cggctctgggtctgtggggagcg

SEQ ID NO: 37187 - DNA, 24 bp, Homo sapiens
cggctctgggtctgtggggagcga

SEQ ID NO: 37188 - DNA, 25 bp, Homo sapiens
cggctctgggtctgtggggagcgaa

SEQ ID NO: 37189 - DNA, 26 bp, Homo sapiens
cggctctgggtctgtggggagcgaaa

SEQ ID NO: 37190 - DNA, 18 bp, Homo sapiens
ccggtcccaggagaacct

SEQ ID NO: 37191 - DNA, 19 bp, Homo sapiens
ccggtcccaggagaacctg

SEQ ID NO: 37192 - DNA, 20 bp, Homo sapiens
ccggtcccaggagaacctgc

SEQ ID NO: 37193 - DNA, 21 bp, Homo sapiens
ccggtcccaggagaacctgca

SEQ ID NO: 37194 - DNA, 22 bp, Homo sapiens
ccggtcccaggagaacctgcag

SEQ ID NO: 37195 - DNA, 24 bp, Homo sapiens
ccggtcccaggagaacctgcagag

SEQ ID NO: 37196 - DNA, 25 bp, Homo sapiens
ccggtcccaggagaacctgcagagg

SEQ ID NO: 37197 - DNA, 23 bp, Homo sapiens
cggtcccaggagaacctgcagag

SEQ ID NO: 37198 - DNA, 22 bp, Homo sapiens
agcggtgctcctgcgggccgac

SEQ ID NO: 37199 - DNA, 23 bp, Homo sapiens
agcggtgctcctgcgggccgaca

SEQ ID NO: 37200 - DNA, 24 bp, Homo sapiens
agcggtgctcctgcgggccgacac

SEQ ID NO: 37201 - DNA, 25 bp, Homo sapiens
agcggtgctcctgcgggccgacact

SEQ ID NO: 37202 - DNA, 18 bp, Homo sapiens
gagggatgggagagagga

SEQ ID NO: 37203 - DNA, 19 bp, Homo sapiens
gagggatgggagagaggac

SEQ ID NO: 37204 - DNA, 20 bp, Homo sapiens
gagggatgggagagaggact

SEQ ID NO: 37205 - DNA, 22 bp, Homo sapiens
gagggatgggagagaggactgt

SEQ ID NO: 37206 - DNA, 24 bp, Homo sapiens
gagggatgggagagaggactgtga

SEQ ID NO: 37207 - DNA, 25 bp, Homo sapiens
gagggatgggagagaggactgtgag

SEQ ID NO: 37208 - DNA, 25 bp, Homo sapiens
atgggagagaggactgtgaggcatg

SEQ ID NO: 37209 - DNA, 21 bp, Homo sapiens
gagagaggactgtgaggcatg

SEQ ID NO: 37210 - DNA, 20 bp, Homo sapiens
gaggactgtgaggcatgggt

SEQ ID NO: 37211 - DNA, 17 bp, Homo sapiens
tgaagcgggggggcggg

SEQ ID NO: 37212 - DNA, 25 bp, Homo sapiens
caaagcacacggcctgcagagaggc

SEQ ID NO: 37213 - DNA, 23 bp, Homo sapiens
aaagcacacggcctgcagagagg

SEQ ID NO: 37214 - DNA, 24 bp, Homo sapiens
caaagcacacggcctgcagagagg

SEQ ID NO: 37215 - DNA, 25 bp, Homo sapiens
gcaaagcacacggcctgcagagagg

SEQ ID NO: 37216 - DNA, 22 bp, Homo sapiens
aaagcacacggcctgcagagag

SEQ ID NO: 37217 - DNA, 23 bp, Homo sapiens
caaagcacacggcctgcagagag

SEQ ID NO: 37218 - DNA, 24 bp, Homo sapiens
gcaaagcacacggcctgcagagag

SEQ ID NO: 37219 - DNA, 21 bp, Homo sapiens
aaagcacacggcctgcagaga

SEQ ID NO: 37220 - DNA, 22 bp, Homo sapiens
caaagcacacggcctgcagaga

SEQ ID NO: 37221 - DNA, 27 bp, Homo sapiens
tctctgggcctgtgtcttaggctctgc

SEQ ID NO: 37222 - DNA, 26 bp, Homo sapiens
tctctgggcctgtgtcttaggctctg

SEQ ID NO: 37223 - DNA, 25 bp, Homo sapiens
tctctgggcctgtgtcttaggctct

SEQ ID NO: 37224 - DNA, 20 bp, Homo sapiens
tgggcctgtgtcttaggctc

SEQ ID NO: 37225 - DNA, 22 bp, Homo sapiens
tctgggcctgtgtcttaggctc

SEQ ID NO: 37226 - DNA, 24 bp, Homo sapiens
tctctgggcctgtgtcttaggctc

SEQ ID NO: 37227 - DNA, 23 bp, Homo sapiens
tctctgggcctgtgtcttaggct

SEQ ID NO: 37228 - DNA, 21 bp, Homo sapiens
tctctgggcctgtgtcttagg

SEQ ID NO: 37229 - DNA, 20 bp, Homo sapiens
tctctgggcctgtgtcttag

SEQ ID NO: 37230 - DNA, 16 bp, Homo sapiens
agagggaccctcccaa

SEQ ID NO: 37231 - DNA, 23 bp, Homo sapiens
acacatttggagagggaccctcc

SEQ ID NO: 37232 - DNA, 24 bp, Homo sapiens
agacacatttggagagggaccctc

SEQ ID NO: 37233 - DNA, 22 bp, Homo sapiens
gacacatttggagagggaccct

SEQ ID NO: 37234 - DNA, 23 bp, Homo sapiens
agacacatttggagagggaccct

SEQ ID NO: 37235 - DNA, 17 bp, Homo sapiens
catttggagagggaccc

SEQ ID NO: 37236 - DNA, 21 bp, Homo sapiens
gacacatttggagagggaccc

SEQ ID NO: 37237 - DNA, 21 bp, Homo sapiens
agacacatttggagagggacc

SEQ ID NO: 37238 - DNA, 17 bp, Homo sapiens
gtccctctccaaatgtg

SEQ ID NO: 37239 - DNA, 20 bp, Homo sapiens
agacacatttggagagggac

SEQ ID NO: 37240 - DNA, 20 bp, Homo sapiens
gtccctctccaaatgtgtct

SEQ ID NO: 37241 - DNA, 21 bp, Homo sapiens
gtccctctccaaatgtgtctt

SEQ ID NO: 37242 - DNA, 23 bp, Homo sapiens
gtccctctccaaatgtgtcttgg

SEQ ID NO: 37243 - DNA, 26 bp, Homo sapiens
ttccctctccaaatgtgtcttgatcc

SEQ ID NO: 37244 - DNA, 20 bp, Homo sapiens
tctccaaatgtgtcttgatc

SEQ ID NO: 37245 - DNA, 21 bp, Homo sapiens
ctctccaaatgtgtcttgatc

SEQ ID NO: 37246 - DNA, 22 bp, Homo sapiens
cctctccaaatgtgtcttgatc

SEQ ID NO: 37247 - DNA, 25 bp, Homo sapiens
ttccctctccaaatgtgtcttgatc

SEQ ID NO: 37248 - DNA, 24 bp, Homo sapiens
ttccctctccaaatgtgtcttgat

SEQ ID NO: 37249 - DNA, 21 bp, Homo sapiens
ccctctccaaatgtgtcttga

SEQ ID NO: 37250 - DNA, 22 bp, Homo sapiens
tccctctccaaatgtgtcttga

SEQ ID NO: 37251 - DNA, 23 bp, Homo sapiens
ttccctctccaaatgtgtcttga

SEQ ID NO: 37252 - DNA, 22 bp, Homo sapiens
ttccctctccaaatgtgtcttg

SEQ ID NO: 37253 - DNA, 21 bp, Homo sapiens
aagacacatttggagagggaa

SEQ ID NO: 37254 - DNA, 22 bp, Homo sapiens
aagacacatttggagagggaac

SEQ ID NO: 37255 - DNA, 20 bp, Homo sapiens
ttccctctccaaatgtgtct

SEQ ID NO: 37256 - DNA, 20 bp, Homo sapiens
agacacatttggagagggaa

SEQ ID NO: 37257 - DNA, 21 bp, Homo sapiens
agacacatttggagagggaac

SEQ ID NO: 37258 - DNA, 23 bp, Homo sapiens
agacacatttggagagggaacct

SEQ ID NO: 37259 - DNA, 24 bp, Homo sapiens
agacacatttggagagggaacctc

SEQ ID NO: 37260 - DNA, 26 bp, Homo sapiens
agacacatttggagagggaacctccc

SEQ ID NO: 37261 - DNA, 27 bp, Homo sapiens
agacacatttggagagggaacctccca

SEQ ID NO: 37262 - DNA, 20 bp, Homo sapiens
gacacatttggagagggaac

SEQ ID NO: 37263 - DNA, 21 bp, Homo sapiens
gacacatttggagagggaacc

SEQ ID NO: 37264 - DNA, 22 bp, Homo sapiens
aggttccctctccaaatgtgtc

SEQ ID NO: 37265 - DNA, 23 bp, Homo sapiens
gacacatttggagagggaacctc

SEQ ID NO: 37266 - DNA, 22 bp, Homo sapiens
acacatttggagagggaacctc

SEQ ID NO: 37267 - DNA, 19 bp, Homo sapiens
tgagacctctgggttctga

SEQ ID NO: 37268 - DNA, 20 bp, Homo sapiens
tgagacctctgggttctgag

SEQ ID NO: 37269 - DNA, 21 bp, Homo sapiens
tgagacctctgggttctgagc

SEQ ID NO: 37270 - DNA, 23 bp, Homo sapiens
tgagacctctgggttctgagctg

SEQ ID NO: 37271 - DNA, 24 bp, Homo sapiens
tgagacctctgggttctgagctgt

SEQ ID NO: 37272 - DNA, 25 bp, Homo sapiens
tgagacctctgggttctgagctgtg

SEQ ID NO: 37273 - DNA, 26 bp, Homo sapiens
tgagacctctgggttctgagctgtga

SEQ ID NO: 37274 - DNA, 28 bp, Homo sapiens
tgagacctctgggttctgagctgtgatg

SEQ ID NO: 37275 - DNA, 21 bp, Homo sapiens
gagacctctgggttctgagct

SEQ ID NO: 37276 - DNA, 16 bp, Homo sapiens
ctgggatctccggggt

SEQ ID NO: 37277 - DNA, 17 bp, Homo sapiens
ctgggatctccggggtc

SEQ ID NO: 37278 - DNA, 20 bp, Homo sapiens
ctgggatctccggggtcttg

SEQ ID NO: 37279 - DNA, 21 bp, Homo sapiens
ctgggatctccggggtcttgg

SEQ ID NO: 37280 - DNA, 22 bp, Homo sapiens
ctgggatctccggggtcttggt

SEQ ID NO: 37281 - DNA, 24 bp, Homo sapiens
ctgggatctccggggtcttggttc

SEQ ID NO: 37282 - DNA, 20 bp, Homo sapiens
tgggatctccggggtcttgg

SEQ ID NO: 37283 - DNA, 21 bp, Homo sapiens
tgggatctccggggtcttggt

SEQ ID NO: 37284 - DNA, 22 bp, Homo sapiens
tgggatctccggggtcttggtt

SEQ ID NO: 37285 - DNA, 23 bp, Homo sapiens
tgggatctccggggtcttggttc

SEQ ID NO: 37286 - DNA, 22 bp, Homo sapiens
gggatctccggggtcttggttc

SEQ ID NO: 37287 - DNA, 25 bp, Homo sapiens
aaaagctgggttgagaaggtgaaaa

SEQ ID NO: 37288 - DNA, 23 bp, Homo sapiens
aaagctgggttgagaaggtgaaa

SEQ ID NO: 37289 - DNA, 24 bp, Homo sapiens
aaaagctgggttgagaaggtgaaa

SEQ ID NO: 37290 - DNA, 22 bp, Homo sapiens
aaagctgggttgagaaggtgaa

SEQ ID NO: 37291 - DNA, 23 bp, Homo sapiens
aaaagctgggttgagaaggtgaa

SEQ ID NO: 37292 - DNA, 19 bp, Homo sapiens
agctgggttgagaaggtga

SEQ ID NO: 37293 - DNA, 21 bp, Homo sapiens
aaagctgggttgagaaggtga

SEQ ID NO: 37294 - DNA, 22 bp, Homo sapiens
aaaagctgggttgagaaggtga

SEQ ID NO: 37295 - DNA, 23 bp, Homo sapiens
gaaaagctgggttgagaaggtga

SEQ ID NO: 37296 - DNA, 21 bp, Homo sapiens
aaaagctgggttgagaaggtg

SEQ ID NO: 37297 - DNA, 20 bp, Homo sapiens
aaaagctgggttgagaaggt

SEQ ID NO: 37298 - DNA, 19 bp, Homo sapiens
aaaagctgggttgagaagg

SEQ ID NO: 37299 - DNA, 18 bp, Homo sapiens
aaaagctgggttgagaag

SEQ ID NO: 37300 - DNA, 19 bp, Homo sapiens
gaaaagctgggttgagaag

SEQ ID NO: 37301 - DNA, 17 bp, Homo sapiens
aaaagctgggttgagaa

SEQ ID NO: 37302 - DNA, 18 bp, Homo sapiens
gaaaagctgggttgagaa

SEQ ID NO: 37303 - DNA, 23 bp, Homo sapiens
gctgtgtggaagactagtgattt

SEQ ID NO: 37304 - DNA, 25 bp, Homo sapiens
tggaagactagtgattttgttgttc

SEQ ID NO: 37305 - DNA, 26 bp, Homo sapiens
tggaagactagtgattttgttgttct

SEQ ID NO: 37306 - DNA, 27 bp, Homo sapiens
tggaagactagtgattttgttgttctg

SEQ ID NO: 37307 - DNA, 28 bp, Homo sapiens
tggaagactagtgattttgttgttctga

SEQ ID NO: 37308 - DNA, 24 bp, Homo sapiens
ggaagactagtgattttgttgttc

SEQ ID NO: 37309 - DNA, 27 bp, Homo sapiens
ggaagactagtgattttgttgttctga

SEQ ID NO: 37310 - DNA, 23 bp, Homo sapiens
gaagactagtgattttgttgttc

SEQ ID NO: 37311 - DNA, 25 bp, Homo sapiens
aagactagtgattttgttgttctga

SEQ ID NO: 37312 - DNA, 21 bp, Homo sapiens
agactagtgattttgttgttc

SEQ ID NO: 37313 - DNA, 25 bp, Homo sapiens
agactagtgattttgttgttctgat

SEQ ID NO: 37314 - DNA, 17 bp, Homo sapiens
tggccagacaggtgacc

SEQ ID NO: 37315 - DNA, 18 bp, Homo sapiens
ctggccagacaggtgacc

SEQ ID NO: 37316 - DNA, 19 bp, Homo sapiens
gctggccagacaggtgacc

SEQ ID NO: 37317 - DNA, 22 bp, Homo sapiens
acgtagctggccagacaggtga

SEQ ID NO: 37318 - DNA, 16 bp, Homo sapiens
cacctgtctggccagc

SEQ ID NO: 37319 - DNA, 17 bp, Homo sapiens
cacctgtctggccagct

SEQ ID NO: 37320 - DNA, 18 bp, Homo sapiens
cacctgtctggccagcta

SEQ ID NO: 37321 - DNA, 22 bp, Homo sapiens
cacctgtctggccagctacgtc

SEQ ID NO: 37322 - DNA, 24 bp, Homo sapiens
cacctgtctggccagctacgtccc

SEQ ID NO: 37323 - DNA, 25 bp, Homo sapiens
cacctgtctggccagctacgtcccc

SEQ ID NO: 37324 - DNA, 19 bp, Homo sapiens
acctgtctggccagctacg

SEQ ID NO: 37325 - DNA, 25 bp, Homo sapiens
tggggacgtagctggccagacaggt

SEQ ID NO: 37326 - DNA, 24 bp, Homo sapiens
tggggacgtagctggccagacagg

SEQ ID NO: 37327 - DNA, 22 bp, Homo sapiens
tggggacgtagctggccagaca

SEQ ID NO: 37328 - DNA, 23 bp, Homo sapiens
tgtctggccagctacgtccccac

SEQ ID NO: 37329 - DNA, 24 bp, Homo sapiens
tgtctggccagctacgtccccacg

SEQ ID NO: 37330 - DNA, 18 bp, Homo sapiens
gtctggccagctacgtcc

SEQ ID NO: 37331 - DNA, 21 bp, Homo sapiens
tggggacgtagctggccagac

SEQ ID NO: 37332 - DNA, 23 bp, Homo sapiens
gtctggccagctacgtccccacg

SEQ ID NO: 37333 - DNA, 22 bp, Homo sapiens
tctggccagctacgtccccacg

SEQ ID NO: 37334 - DNA, 19 bp, Homo sapiens
agctacgtccccacggccc

SEQ ID NO: 37335 - DNA, 17 bp, Homo sapiens
ctacgtccccacggccc

SEQ ID NO: 37336 - DNA, 23 bp, Homo sapiens
tggccgtctaccttccacactga

SEQ ID NO: 37337 - DNA, 23 bp, Homo sapiens
tctggccgtctaccttccacact

SEQ ID NO: 37338 - DNA, 23 bp, Homo sapiens
agtgtggaaggtagacggccaga

SEQ ID NO: 37339 - DNA, 24 bp, Homo sapiens
ctctggccgtctaccttccacact

SEQ ID NO: 37340 - DNA, 19 bp, Homo sapiens
tggccgtctaccttccaca

SEQ ID NO: 37341 - DNA, 20 bp, Homo sapiens
tgtggaaggtagacggccag

SEQ ID NO: 37342 - DNA, 21 bp, Homo sapiens
tctggccgtctaccttccaca

SEQ ID NO: 37343 - DNA, 21 bp, Homo sapiens
tgtggaaggtagacggccaga

SEQ ID NO: 37344 - DNA, 22 bp, Homo sapiens
ctctggccgtctaccttccaca

SEQ ID NO: 37345 - DNA, 23 bp, Homo sapiens
tctctggccgtctaccttccaca

SEQ ID NO: 37346 - DNA, 21 bp, Homo sapiens
gtggaaggtagacggccagag

SEQ ID NO: 37347 - DNA, 22 bp, Homo sapiens
tctctggccgtctaccttccac

SEQ ID NO: 37348 - DNA, 22 bp, Homo sapiens
gtggaaggtagacggccagaga

SEQ ID NO: 37349 - DNA, 23 bp, Homo sapiens
gtggaaggtagacggccagagag

SEQ ID NO: 37350 - DNA, 16 bp, Homo sapiens
tggaaggtagacggcc

SEQ ID NO: 37351 - DNA, 17 bp, Homo sapiens
tggaaggtagacggcca

SEQ ID NO: 37352 - DNA, 18 bp, Homo sapiens
tggaaggtagacggccag

SEQ ID NO: 37353 - DNA, 20 bp, Homo sapiens
ctctggccgtctaccttcca

SEQ ID NO: 37354 - DNA, 21 bp, Homo sapiens
tctctggccgtctaccttcca

SEQ ID NO: 37355 - DNA, 21 bp, Homo sapiens
tggaaggtagacggccagaga

SEQ ID NO: 37356 - DNA, 22 bp, Homo sapiens
tggaaggtagacggccagagag

SEQ ID NO: 37357 - DNA, 23 bp, Homo sapiens
tggaaggtagacggccagagagg

SEQ ID NO: 37358 - DNA, 24 bp, Homo sapiens
tggaaggtagacggccagagaggt

SEQ ID NO: 37359 - DNA, 23 bp, Homo sapiens
aaggtagacggccagagaggtga

SEQ ID NO: 37360 - DNA, 24 bp, Homo sapiens
ggtcacctctctggccgtctacct

SEQ ID NO: 37361 - DNA, 20 bp, Homo sapiens
ggtcacctctctggccgtct

SEQ ID NO: 37362 - DNA, 17 bp, Homo sapiens
gacggccagagaggtga

SEQ ID NO: 37363 - DNA, 18 bp, Homo sapiens
gacggccagagaggtgac

SEQ ID NO: 37364 - DNA, 19 bp, Homo sapiens
ggtcacctctctggccgtc

SEQ ID NO: 37365 - DNA, 17 bp, Homo sapiens
acggccagagaggtgac

SEQ ID NO: 37366 - DNA, 16 bp, Homo sapiens
cggccagagaggtgac

SEQ ID NO: 37367 - DNA, 16 bp, Homo sapiens
ggtcacctctctggcc

SEQ ID NO: 37368 - DNA, 19 bp, Homo sapiens
tgagggaaggaggcttggt

SEQ ID NO: 37369 - DNA, 20 bp, Homo sapiens
tgagggaaggaggcttggtc

SEQ ID NO: 37370 - DNA, 21 bp, Homo sapiens
tgagggaaggaggcttggtct

SEQ ID NO: 37371 - DNA, 25 bp, Homo sapiens
tgagggaaggaggcttggtcttagc

SEQ ID NO: 37372 - DNA, 23 bp, Homo sapiens
gagggaaggaggcttggtcttag

SEQ ID NO: 37373 - DNA, 24 bp, Homo sapiens
gagggaaggaggcttggtcttagc

SEQ ID NO: 37374 - DNA, 19 bp, Homo sapiens
agggaaggaggcttggtct

SEQ ID NO: 37375 - DNA, 20 bp, Homo sapiens
agggaaggaggcttggtctt

SEQ ID NO: 37376 - DNA, 21 bp, Homo sapiens
agggaaggaggcttggtctta

SEQ ID NO: 37377 - DNA, 23 bp, Homo sapiens
agggaaggaggcttggtcttagc

SEQ ID NO: 37378 - DNA, 24 bp, Homo sapiens
agggaaggaggcttggtcttagca

SEQ ID NO: 37379 - DNA, 20 bp, Homo sapiens
aaggcccgggctttcctccc

SEQ ID NO: 37380 - DNA, 23 bp, Homo sapiens
aaggcccgggctttcctcccagc

SEQ ID NO: 37381 - DNA, 24 bp, Homo sapiens
aaggcccgggctttcctcccagct

SEQ ID NO: 37382 - DNA, 21 bp, Homo sapiens
aggcccgggctttcctcccag

SEQ ID NO: 37383 - DNA, 22 bp, Homo sapiens
aggcccgggctttcctcccagc

SEQ ID NO: 37384 - DNA, 23 bp, Homo sapiens
ggcccgggctttcctcccagcta

SEQ ID NO: 37385 - DNA, 19 bp, Homo sapiens
gctttcctcccagctaccc

SEQ ID NO: 37386 - DNA, 24 bp, Homo sapiens
agccagggggatgggcgagcttgg

SEQ ID NO: 37387 - DNA, 19 bp, Homo sapiens
gccagggggatgggcgagc

SEQ ID NO: 37388 - DNA, 22 bp, Homo sapiens
gccagggggatgggcgagcttg

SEQ ID NO: 37389 - DNA, 23 bp, Homo sapiens
gccagggggatgggcgagcttgg

SEQ ID NO: 37390 - DNA, 25 bp, Homo sapiens
gccagggggatgggcgagcttgggc

SEQ ID NO: 37391 - DNA, 24 bp, Homo sapiens
ccagggggatgggcgagcttgggc

SEQ ID NO: 37392 - DNA, 25 bp, Homo sapiens
ccagggggatgggcgagcttgggcc

SEQ ID NO: 37393 - DNA, 20 bp, Homo sapiens
cagggggatgggcgagcttg

SEQ ID NO: 37394 - DNA, 24 bp, Homo sapiens
cagggggatgggcgagcttgggcc

SEQ ID NO: 37395 - DNA, 20 bp, Homo sapiens
cctaccccccatccccctgt

SEQ ID NO: 37396 - DNA, 22 bp, Homo sapiens
cctaccccccatccccctgtag

SEQ ID NO: 37397 - DNA, 23 bp, Homo sapiens
cctaccccccatccccctgtagg

SEQ ID NO: 37398 - DNA, 18 bp, Homo sapiens
ctaccccccatccccctg

SEQ ID NO: 37399 - DNA, 19 bp, Homo sapiens
ctaccccccatccccctgt

SEQ ID NO: 37400 - DNA, 22 bp, Homo sapiens
ctaccccccatccccctgtagg

SEQ ID NO: 37401 - DNA, 23 bp, Homo sapiens
ctaccccccatccccctgtaggg

SEQ ID NO: 37402 - DNA, 21 bp, Homo sapiens
taccccccatccccctgtagg

SEQ ID NO: 37403 - DNA, 25 bp, Homo sapiens
accctgagaccctaaccttaaaggt

SEQ ID NO: 37404 - DNA, 22 bp, Homo sapiens
ccctgagaccctaaccttaaag

SEQ ID NO: 37405 - DNA, 22 bp, Homo sapiens
accctgagaccctaaccttaaa

SEQ ID NO: 37406 - DNA, 21 bp, Homo sapiens
accctgagaccctaaccttaa

SEQ ID NO: 37407 - DNA, 20 bp, Homo sapiens
accctgagaccctaacctta

SEQ ID NO: 37408 - DNA, 19 bp, Homo sapiens
accctgagaccctaacctt

SEQ ID NO: 37409 - DNA, 22 bp, Homo sapiens
ttaaaaccctgagaccctaacc

SEQ ID NO: 37410 - DNA, 21 bp, Homo sapiens
ttaaaaccctgagaccctaac

SEQ ID NO: 37411 - DNA, 18 bp, Homo sapiens
ttaaaaccctgagaccct

SEQ ID NO: 37412 - DNA, 25 bp, Homo sapiens
ctggtacaggcctgggggacaggga

SEQ ID NO: 37413 - DNA, 20 bp, Homo sapiens
tacaggcctgggggacaggg

SEQ ID NO: 37414 - DNA, 23 bp, Homo sapiens
tggtacaggcctgggggacaggg

SEQ ID NO: 37415 - DNA, 24 bp, Homo sapiens
ctggtacaggcctgggggacaggg

SEQ ID NO: 37416 - DNA, 23 bp, Homo sapiens
ctggtacaggcctgggggacagg

SEQ ID NO: 37417 - DNA, 24 bp, Homo sapiens
cctggtacaggcctgggggacagg

SEQ ID NO: 37418 - DNA, 20 bp, Homo sapiens
ggtacaggcctgggggacag

SEQ ID NO: 37419 - DNA, 21 bp, Homo sapiens
tggtacaggcctgggggacag

SEQ ID NO: 37420 - DNA, 23 bp, Homo sapiens
cctggtacaggcctgggggacag

SEQ ID NO: 37421 - DNA, 21 bp, Homo sapiens
ctggtacaggcctgggggaca

SEQ ID NO: 37422 - DNA, 22 bp, Homo sapiens
cctggtacaggcctgggggaca

SEQ ID NO: 37423 - DNA, 20 bp, Homo sapiens
ctggtacaggcctgggggac

SEQ ID NO: 37424 - DNA, 18 bp, Homo sapiens
tggtacaggcctggggga

SEQ ID NO: 37425 - DNA, 19 bp, Homo sapiens
ctggtacaggcctggggga

SEQ ID NO: 37426 - DNA, 18 bp, Homo sapiens
ctggtacaggcctggggg

SEQ ID NO: 37427 - DNA, 24 bp, Homo sapiens
tctcccaacccttgtaccagtgct

SEQ ID NO: 37428 - DNA, 22 bp, Homo sapiens
ctcccaacccttgtaccagtgc

SEQ ID NO: 37429 - DNA, 23 bp, Homo sapiens
tctcccaacccttgtaccagtgc

SEQ ID NO: 37430 - DNA, 21 bp, Homo sapiens
tctcccaacccttgtaccagt

SEQ ID NO: 37431 - DNA, 20 bp, Homo sapiens
tctcccaacccttgtaccag

SEQ ID NO: 37432 - DNA, 19 bp, Homo sapiens
tctcccaacccttgtacca

SEQ ID NO: 37433 - DNA, 27 bp, Homo sapiens
ctcaccctcccttcttcctgggccctc

SEQ ID NO: 37434 - DNA, 27 bp, Homo sapiens
ctcaccctcccttcttcctgggccctc

SEQ ID NO: 37435 - DNA, 26 bp, Homo sapiens
tcaccctcccttcttcctgggccctc

SEQ ID NO: 37436 - DNA, 26 bp, Homo sapiens
tcaccctcccttcttcctgggccctc

SEQ ID NO: 37437 - DNA, 20 bp, Homo sapiens
ctcccttcttcctgggccct

SEQ ID NO: 37438 - DNA, 20 bp, Homo sapiens
ctcccttcttcctgggccct

SEQ ID NO: 37439 - DNA, 22 bp, Homo sapiens
ctcccttcttcctgggccctca

SEQ ID NO: 37440 - DNA, 22 bp, Homo sapiens
ctcccttcttcctgggccctca

SEQ ID NO: 37441 - DNA, 23 bp, Homo sapiens
ctcccttcttcctgggccctcag

SEQ ID NO: 37442 - DNA, 23 bp, Homo sapiens
ctcccttcttcctgggccctcag

SEQ ID NO: 37443 - DNA, 20 bp, Homo sapiens
tcccttcttcctgggccctc

SEQ ID NO: 37444 - DNA, 20 bp, Homo sapiens
tcccttcttcctgggccctc

SEQ ID NO: 37445 - DNA, 21 bp, Homo sapiens
tcccttcttcctgggccctca

SEQ ID NO: 37446 - DNA, 21 bp, Homo sapiens
tcccttcttcctgggccctca

SEQ ID NO: 37447 - DNA, 22 bp, Homo sapiens
tcccttcttcctgggccctcag

SEQ ID NO: 37448 - DNA, 22 bp, Homo sapiens
tcccttcttcctgggccctcag

SEQ ID NO: 37449 - DNA, 23 bp, Homo sapiens
tcccttcttcctgggccctcaga

SEQ ID NO: 37450 - DNA, 23 bp, Homo sapiens
tcccttcttcctgggccctcaga

SEQ ID NO: 37451 - DNA, 24 bp, Homo sapiens
tcccttcttcctgggccctcagat

SEQ ID NO: 37452 - DNA, 24 bp, Homo sapiens
tcccttcttcctgggccctcagat

SEQ ID NO: 37453 - DNA, 24 bp, Homo sapiens
aggaggggaggtgtgcagggctgg

SEQ ID NO: 37454 - DNA, 22 bp, Homo sapiens
gaggggaggtgtgcagggctgg

SEQ ID NO: 37455 - DNA, 24 bp, Homo sapiens
gaggggaggtgtgcagggctgggg

SEQ ID NO: 37456 - DNA, 25 bp, Homo sapiens
gaggggaggtgtgcagggctggggt

SEQ ID NO: 37457 - DNA, 20 bp, Homo sapiens
aggggaggtgtgcagggctg

SEQ ID NO: 37458 - DNA, 21 bp, Homo sapiens
aggggaggtgtgcagggctgg

SEQ ID NO: 37459 - DNA, 22 bp, Homo sapiens
aggggaggtgtgcagggctggg

SEQ ID NO: 37460 - DNA, 23 bp, Homo sapiens
aggggaggtgtgcagggctgggg

SEQ ID NO: 37461 - DNA, 19 bp, Homo sapiens
ggggaggtgtgcagggctg

SEQ ID NO: 37462 - DNA, 19 bp, Homo sapiens
ttcccctgccctgcatggt

SEQ ID NO: 37463 - DNA, 22 bp, Homo sapiens
cctgccctgcatggtgtcccca

SEQ ID NO: 37464 - DNA, 19 bp, Homo sapiens
tgccctgcatggtgtcccc

SEQ ID NO: 37465 - DNA, 20 bp, Homo sapiens
tgccctgcatggtgtcccca

SEQ ID NO: 37466 - DNA, 21 bp, Homo sapiens
tgccctgcatggtgtccccac

SEQ ID NO: 37467 - DNA, 22 bp, Homo sapiens
tgccctgcatggtgtccccaca

SEQ ID NO: 37468 - DNA, 24 bp, Homo sapiens
tgccctgcatggtgtccccacagg

SEQ ID NO: 37469 - DNA, 25 bp, Homo sapiens
tgccctgcatggtgtccccacaggg

SEQ ID NO: 37470 - DNA, 26 bp, Homo sapiens
tgccctgcatggtgtccccacaggga

SEQ ID NO: 37471 - DNA, 23 bp, Homo sapiens
gccctgcatggtgtccccacagg

SEQ ID NO: 37472 - DNA, 16 bp, Homo sapiens
gaacctgtaggtgaca

SEQ ID NO: 37473 - DNA, 17 bp, Homo sapiens
gtaggtgacagtcaggg

SEQ ID NO: 37474 - DNA, 20 bp, Homo sapiens
gtaggtgacagtcaggggcg

SEQ ID NO: 37475 - DNA, 22 bp, Homo sapiens
gtaggtgacagtcaggggcggg

SEQ ID NO: 37476 - DNA, 23 bp, Homo sapiens
gtaggtgacagtcaggggcgggg

SEQ ID NO: 37477 - DNA, 24 bp, Homo sapiens
gtaggtgacagtcaggggcggggt

SEQ ID NO: 37478 - DNA, 25 bp, Homo sapiens
gtaggtgacagtcaggggcggggtg

SEQ ID NO: 37479 - DNA, 26 bp, Homo sapiens
gtaggtgacagtcaggggcggggtgt

SEQ ID NO: 37480 - DNA, 21 bp, Homo sapiens
taggtgacagtcaggggcggg

SEQ ID NO: 37481 - DNA, 23 bp, Homo sapiens
taggtgacagtcaggggcggggt

SEQ ID NO: 37482 - DNA, 24 bp, Homo sapiens
taggtgacagtcaggggcggggtg

SEQ ID NO: 37483 - DNA, 26 bp, Homo sapiens
taggtgacagtcaggggcggggtgtg

SEQ ID NO: 37484 - DNA, 17 bp, Homo sapiens
aggtgacagtcaggggc

SEQ ID NO: 37485 - DNA, 18 bp, Homo sapiens
aggtgacagtcaggggcg

SEQ ID NO: 37486 - DNA, 16 bp, Homo sapiens
tcaggggcggggtgtg

SEQ ID NO: 37487 - DNA, 18 bp, Homo sapiens
tcctcacacctctcctgg

SEQ ID NO: 37488 - DNA, 20 bp, Homo sapiens
tcctcacacctctcctggca

SEQ ID NO: 37489 - DNA, 21 bp, Homo sapiens
tcctcacacctctcctggcat

SEQ ID NO: 37490 - DNA, 22 bp, Homo sapiens
tcctcacacctctcctggcatc

SEQ ID NO: 37491 - DNA, 23 bp, Homo sapiens
tcctcacacctctcctggcatcg

SEQ ID NO: 37492 - DNA, 25 bp, Homo sapiens
tcctcacacctctcctggcatcgcc

SEQ ID NO: 37493 - DNA, 22 bp, Homo sapiens
cacctctcctggcatcgccccc

SEQ ID NO: 37494 - DNA, 24 bp, Homo sapiens
cacctctcctggcatcgcccccag

SEQ ID NO: 37495 - DNA, 25 bp, Homo sapiens
cacctctcctggcatcgcccccagg

SEQ ID NO: 37496 - DNA, 22 bp, Homo sapiens
acctctcctggcatcgccccca

SEQ ID NO: 37497 - DNA, 20 bp, Homo sapiens
cctctcctggcatcgccccc

SEQ ID NO: 37498 - DNA, 23 bp, Homo sapiens
tccctgcggggacaggccagggc

SEQ ID NO: 37499 - DNA, 26 bp, Homo sapiens
tccctgcggggacaggccagggcatc

SEQ ID NO: 37500 - DNA, 23 bp, Homo sapiens
ccctgcggggacaggccagggca

SEQ ID NO: 37501 - DNA, 24 bp, Homo sapiens
ccctgcggggacaggccagggcat

SEQ ID NO: 37502 - DNA, 23 bp, Homo sapiens
ctgcggggacaggccagggcatc

SEQ ID NO: 37503 - DNA, 18 bp, Homo sapiens
tgcggggacaggccaggg

SEQ ID NO: 37504 - DNA, 21 bp, Homo sapiens
tgcggggacaggccagggcat

SEQ ID NO: 37505 - DNA, 23 bp, Homo sapiens
tgcggggacaggccagggcatct

SEQ ID NO: 37506 - DNA, 21 bp, Homo sapiens
cggggacaggccagggcatct

SEQ ID NO: 37507 - DNA, 22 bp, Homo sapiens
cggggacaggccagggcatcta

SEQ ID NO: 37508 - DNA, 16 bp, Homo sapiens
ccagggcatctaggct

SEQ ID NO: 37509 - DNA, 19 bp, Homo sapiens
tgacgcccctcctgccccc

SEQ ID NO: 37510 - DNA, 23 bp, Homo sapiens
acgcccctcctgcccccacagaa

SEQ ID NO: 37511 - DNA, 17 bp, Homo sapiens
cgcccctcctgccccca

SEQ ID NO: 37512 - DNA, 19 bp, Homo sapiens
cgcccctcctgcccccaca

SEQ ID NO: 37513 - DNA, 21 bp, Homo sapiens
cgcccctcctgcccccacaga

SEQ ID NO: 37514 - DNA, 22 bp, Homo sapiens
cgcccctcctgcccccacagaa

SEQ ID NO: 37515 - DNA, 23 bp, Homo sapiens
cgcccctcctgcccccacagaag

SEQ ID NO: 37516 - DNA, 20 bp, Homo sapiens
tgggcgctcgggcggaggtg

SEQ ID NO: 37517 - DNA, 21 bp, Homo sapiens
tgggcgctcgggcggaggtgg

SEQ ID NO: 37518 - DNA, 22 bp, Homo sapiens
tgggcgctcgggcggaggtggt

SEQ ID NO: 37519 - DNA, 21 bp, Homo sapiens
gctcgggcggaggtggttgag

SEQ ID NO: 37520 - DNA, 23 bp, Homo sapiens
gctcgggcggaggtggttgagtg

SEQ ID NO: 37521 - DNA, 24 bp, Homo sapiens
gctcgggcggaggtggttgagtgc

SEQ ID NO: 37522 - DNA, 25 bp, Homo sapiens
gctcgggcggaggtggttgagtgcc

SEQ ID NO: 37523 - DNA, 17 bp, Homo sapiens
ctcgggcggaggtggtt

SEQ ID NO: 37524 - DNA, 19 bp, Homo sapiens
ctcgggcggaggtggttga

SEQ ID NO: 37525 - DNA, 23 bp, Homo sapiens
ctcgggcggaggtggttgagtgc

SEQ ID NO: 37526 - DNA, 26 bp, Homo sapiens
ctcgggcggaggtggttgagtgccga

SEQ ID NO: 37527 - DNA, 21 bp, Homo sapiens
tcgggcggaggtggttgagtg

SEQ ID NO: 37528 - DNA, 22 bp, Homo sapiens
tcgggcggaggtggttgagtgc

SEQ ID NO: 37529 - DNA, 23 bp, Homo sapiens
tcgggcggaggtggttgagtgcc

SEQ ID NO: 37530 - DNA, 23 bp, Homo sapiens
cgcctgacccaccccctcccgca

SEQ ID NO: 37531 - DNA, 22 bp, Homo sapiens
gcctgacccaccccctcccgca

SEQ ID NO: 37532 - DNA, 23 bp, Homo sapiens
gcctgacccaccccctcccgcag

SEQ ID NO: 37533 - DNA, 20 bp, Homo sapiens
cctgacccaccccctcccgc

SEQ ID NO: 37534 - DNA, 21 bp, Homo sapiens
cctgacccaccccctcccgca

SEQ ID NO: 37535 - DNA, 23 bp, Homo sapiens
cctgacccaccccctcccgcagc

SEQ ID NO: 37536 - DNA, 24 bp, Homo sapiens
cctgacccaccccctcccgcagca

SEQ ID NO: 37537 - DNA, 21 bp, Homo sapiens
ctgacccaccccctcccgcag

SEQ ID NO: 37538 - DNA, 22 bp, Homo sapiens
ctgacccaccccctcccgcagc

SEQ ID NO: 37539 - DNA, 16 bp, Homo sapiens
ggagccagaggacccg

SEQ ID NO: 37540 - DNA, 21 bp, Homo sapiens
ggagccagaggacccgtagct

SEQ ID NO: 37541 - DNA, 28 bp, Homo sapiens
gagccagaggacccgtagctgctagaag

SEQ ID NO: 37542 - DNA, 17 bp, Homo sapiens
ccagaggacccgtagct

SEQ ID NO: 37543 - DNA, 21 bp, Homo sapiens
agaggacccgtagctgctaga

SEQ ID NO: 37544 - DNA, 22 bp, Homo sapiens
agaggacccgtagctgctagaa

SEQ ID NO: 37545 - DNA, 23 bp, Homo sapiens
agaggacccgtagctgctagaag

SEQ ID NO: 37546 - DNA, 25 bp, Homo sapiens
agaggacccgtagctgctagaaggg

SEQ ID NO: 37547 - DNA, 19 bp, Homo sapiens
gaggacccgtagctgctag

SEQ ID NO: 37548 - DNA, 16 bp, Homo sapiens
tgctagaagggcaggg

SEQ ID NO: 37549 - DNA, 22 bp, Homo sapiens
atggcgagactggcatgtactc

SEQ ID NO: 37550 - DNA, 22 bp, Homo sapiens
ctatggcgagactggcatgtac

SEQ ID NO: 37551 - DNA, 22 bp, Homo sapiens
cctatggcgagactggcatgta

SEQ ID NO: 37552 - DNA, 23 bp, Homo sapiens
tcctatggcgagactggcatgta

SEQ ID NO: 37553 - DNA, 16 bp, Homo sapiens
tatggcgagactggca

SEQ ID NO: 37554 - DNA, 16 bp, Homo sapiens
cacccgtagaaccgac

SEQ ID NO: 37555 - DNA, 17 bp, Homo sapiens
cacccgtagaaccgacc

SEQ ID NO: 37556 - DNA, 18 bp, Homo sapiens
cacccgtagaaccgacct

SEQ ID NO: 37557 - DNA, 19 bp, Homo sapiens
cacccgtagaaccgacctt

SEQ ID NO: 37558 - DNA, 20 bp, Homo sapiens
cacccgtagaaccgaccttg

SEQ ID NO: 37559 - DNA, 21 bp, Homo sapiens
cacccgtagaaccgaccttgc

SEQ ID NO: 37560 - DNA, 23 bp, Homo sapiens
cacccgtagaaccgaccttgcgg

SEQ ID NO: 37561 - DNA, 24 bp, Homo sapiens
cacccgtagaaccgaccttgcggg

SEQ ID NO: 37562 - DNA, 21 bp, Homo sapiens
acccgtagaaccgaccttgcg

SEQ ID NO: 37563 - DNA, 22 bp, Homo sapiens
acccgtagaaccgaccttgcgg

SEQ ID NO: 37564 - DNA, 17 bp, Homo sapiens
caagctcgtgtctgtgg

SEQ ID NO: 37565 - DNA, 18 bp, Homo sapiens
caagctcgtgtctgtggg

SEQ ID NO: 37566 - DNA, 19 bp, Homo sapiens
caagctcgtgtctgtgggt

SEQ ID NO: 37567 - DNA, 20 bp, Homo sapiens
caagctcgtgtctgtgggtc

SEQ ID NO: 37568 - DNA, 21 bp, Homo sapiens
caagctcgtgtctgtgggtcc

SEQ ID NO: 37569 - DNA, 23 bp, Homo sapiens
caagctcgtgtctgtgggtccgt

SEQ ID NO: 37570 - DNA, 24 bp, Homo sapiens
caagctcgtgtctgtgggtccgtg

SEQ ID NO: 37571 - DNA, 25 bp, Homo sapiens
caagctcgtgtctgtgggtccgtgt

SEQ ID NO: 37572 - DNA, 26 bp, Homo sapiens
caagctcgtgtctgtgggtccgtgtc

SEQ ID NO: 37573 - DNA, 18 bp, Homo sapiens
aagctcgtgtctgtgggt

SEQ ID NO: 37574 - DNA, 19 bp, Homo sapiens
tgaggtaggaggttgtata

SEQ ID NO: 37575 - DNA, 20 bp, Homo sapiens
tgaggtaggaggttgtatag

SEQ ID NO: 37576 - DNA, 21 bp, Homo sapiens
tgaggtaggaggttgtatagt

SEQ ID NO: 37577 - DNA, 23 bp, Homo sapiens
tgaggtaggaggttgtatagttg

SEQ ID NO: 37578 - DNA, 24 bp, Homo sapiens
tgaggtaggaggttgtatagttga

SEQ ID NO: 37579 - DNA, 27 bp, Homo sapiens
tgaggtaggaggttgtatagttgagga

SEQ ID NO: 37580 - DNA, 27 bp, Homo sapiens
gatcactatacggcctcctagctttcc

SEQ ID NO: 37581 - DNA, 25 bp, Homo sapiens
atcactatacggcctcctagctttc

SEQ ID NO: 37582 - DNA, 23 bp, Homo sapiens
tcactatacggcctcctagcttt

SEQ ID NO: 37583 - DNA, 23 bp, Homo sapiens
cactatacggcctcctagctttc

SEQ ID NO: 37584 - DNA, 16 bp, Homo sapiens
ctatacggcctcctag

SEQ ID NO: 37585 - DNA, 17 bp, Homo sapiens
ctatacggcctcctagc

SEQ ID NO: 37586 - DNA, 20 bp, Homo sapiens
ctatacggcctcctagcttt

SEQ ID NO: 37587 - DNA, 21 bp, Homo sapiens
ctatacggcctcctagctttc

SEQ ID NO: 37588 - DNA, 23 bp, Homo sapiens
ctatacggcctcctagctttccc

SEQ ID NO: 37589 - DNA, 24 bp, Homo sapiens
ctatacggcctcctagctttcccc

SEQ ID NO: 37590 - DNA, 22 bp, Homo sapiens
tatacggcctcctagctttccc

SEQ ID NO: 37591 - DNA, 17 bp, Homo sapiens
tccctgagaccctttaa

SEQ ID NO: 37592 - DNA, 19 bp, Homo sapiens
tccctgagaccctttaacc

SEQ ID NO: 37593 - DNA, 20 bp, Homo sapiens
tccctgagaccctttaacct

SEQ ID NO: 37594 - DNA, 21 bp, Homo sapiens
tccctgagaccctttaacctg

SEQ ID NO: 37595 - DNA, 22 bp, Homo sapiens
tccctgagaccctttaacctgt

SEQ ID NO: 37596 - DNA, 23 bp, Homo sapiens
tccctgagaccctttaacctgtg

SEQ ID NO: 37597 - DNA, 25 bp, Homo sapiens
tccctgagaccctttaacctgtgag

SEQ ID NO: 37598 - DNA, 27 bp, Homo sapiens
tccctgagaccctttaacctgtgagga

SEQ ID NO: 37599 - DNA, 17 bp, Homo sapiens
acaggtgaggttcttgg

SEQ ID NO: 37600 - DNA, 18 bp, Homo sapiens
acaggtgaggttcttggg

SEQ ID NO: 37601 - DNA, 19 bp, Homo sapiens
acaggtgaggttcttggga

SEQ ID NO: 37602 - DNA, 20 bp, Homo sapiens
acaggtgaggttcttgggag

SEQ ID NO: 37603 - DNA, 21 bp, Homo sapiens
acaggtgaggttcttgggagc

SEQ ID NO: 37604 - DNA, 23 bp, Homo sapiens
acaggtgaggttcttgggagcct

SEQ ID NO: 37605 - DNA, 24 bp, Homo sapiens
acaggtgaggttcttgggagcctg

SEQ ID NO: 37606 - DNA, 25 bp, Homo sapiens
acaggtgaggttcttgggagcctgg

SEQ ID NO: 37607 - DNA, 20 bp, Homo sapiens
caggtgaggttcttgggagc

SEQ ID NO: 37608 - DNA, 21 bp, Homo sapiens
caggtgaggttcttgggagcc

SEQ ID NO: 37609 - DNA, 20 bp, Homo sapiens
ctggtcagaggcagcaggaa

SEQ ID NO: 37610 - DNA, 21 bp, Homo sapiens
ctggtcagaggcagcaggaaa

SEQ ID NO: 37611 - DNA, 22 bp, Homo sapiens
ctggtcagaggcagcaggaaat

SEQ ID NO: 37612 - DNA, 19 bp, Homo sapiens
tggtcagaggcagcaggaa

SEQ ID NO: 37613 - DNA, 20 bp, Homo sapiens
tggtcagaggcagcaggaaa

SEQ ID NO: 37614 - DNA, 21 bp, Homo sapiens
tggtcagaggcagcaggaaat

SEQ ID NO: 37615 - DNA, 22 bp, Homo sapiens
tggtcagaggcagcaggaaatg

SEQ ID NO: 37616 - DNA, 24 bp, Homo sapiens
tggtcagaggcagcaggaaatgag

SEQ ID NO: 37617 - DNA, 25 bp, Homo sapiens
tggtcagaggcagcaggaaatgaga

SEQ ID NO: 37618 - DNA, 27 bp, Homo sapiens
tggtcagaggcagcaggaaatgagagt

SEQ ID NO: 37619 - DNA, 24 bp, Homo sapiens
gtcagaggcagcaggaaatgagag

SEQ ID NO: 37620 - DNA, 22 bp, Homo sapiens
tcacccctgccactcactggcc

SEQ ID NO: 37621 - DNA, 23 bp, Homo sapiens
tcacccctgccactcactggccc

SEQ ID NO: 37622 - DNA, 24 bp, Homo sapiens
tcacccctgccactcactggcccc

SEQ ID NO: 37623 - DNA, 25 bp, Homo sapiens
tcacccctgccactcactggccccc

SEQ ID NO: 37624 - DNA, 26 bp, Homo sapiens
tcacccctgccactcactggccccca

SEQ ID NO: 37625 - DNA, 27 bp, Homo sapiens
tcacccctgccactcactggcccccag

SEQ ID NO: 37626 - DNA, 24 bp, Homo sapiens
cacccctgccactcactggccccc

SEQ ID NO: 37627 - DNA, 19 bp, Homo sapiens
acccctgccactcactggc

SEQ ID NO: 37628 - DNA, 21 bp, Homo sapiens
acccctgccactcactggccc

SEQ ID NO: 37629 - DNA, 22 bp, Homo sapiens
acccctgccactcactggcccc

SEQ ID NO: 37630 - DNA, 23 bp, Homo sapiens
acccctgccactcactggccccc

SEQ ID NO: 37631 - DNA, 24 bp, Homo sapiens
acccctgccactcactggccccca

SEQ ID NO: 37632 - DNA, 25 bp, Homo sapiens
acccctgccactcactggcccccag

SEQ ID NO: 37633 - DNA, 26 bp, Homo sapiens
acccctgccactcactggcccccagg

SEQ ID NO: 37634 - DNA, 21 bp, Homo sapiens
cccctgccactcactggcccc

SEQ ID NO: 37635 - DNA, 22 bp, Homo sapiens
cccctgccactcactggccccc

SEQ ID NO: 37636 - DNA, 23 bp, Homo sapiens
cccctgccactcactggccccca

SEQ ID NO: 37637 - DNA, 24 bp, Homo sapiens
cccctgccactcactggcccccag

SEQ ID NO: 37638 - DNA, 21 bp, Homo sapiens
ctgccactcactggcccccag

SEQ ID NO: 37639 - DNA, 22 bp, Homo sapiens
gacacttgtatgctagctcagg

SEQ ID NO: 37640 - DNA, 18 bp, Homo sapiens
acacttgtatgctagctc

SEQ ID NO: 37641 - DNA, 19 bp, Homo sapiens
acacttgtatgctagctca

SEQ ID NO: 37642 - DNA, 20 bp, Homo sapiens
acacttgtatgctagctcag

SEQ ID NO: 37643 - DNA, 21 bp, Homo sapiens
acacttgtatgctagctcagg

SEQ ID NO: 37644 - DNA, 22 bp, Homo sapiens
acacttgtatgctagctcaggt

SEQ ID NO: 37645 - DNA, 23 bp, Homo sapiens
acacttgtatgctagctcaggta

SEQ ID NO: 37646 - DNA, 24 bp, Homo sapiens
acacttgtatgctagctcaggtag

SEQ ID NO: 37647 - DNA, 26 bp, Homo sapiens
acacttgtatgctagctcaggtagat

SEQ ID NO: 37648 - DNA, 20 bp, Homo sapiens
cacttgtatgctagctcagg

SEQ ID NO: 37649 - DNA, 21 bp, Homo sapiens
cacttgtatgctagctcaggt

SEQ ID NO: 37650 - DNA, 22 bp, Homo sapiens
cacttgtatgctagctcaggta

SEQ ID NO: 37651 - DNA, 23 bp, Homo sapiens
cacttgtatgctagctcaggtag

SEQ ID NO: 37652 - DNA, 20 bp, Homo sapiens
acttgtatgctagctcaggt

SEQ ID NO: 37653 - DNA, 23 bp, Homo sapiens
acttgtatgctagctcaggtaga

SEQ ID NO: 37654 - DNA, 25 bp, Homo sapiens
acttgtatgctagctcaggtagata

SEQ ID NO: 37655 - DNA, 26 bp, Homo sapiens
cttgtatgctagctcaggtagatatt

SEQ ID NO: 37656 - DNA, 19 bp, Homo sapiens
tcaaaactgaggggcattt

SEQ ID NO: 37657 - DNA, 20 bp, Homo sapiens
tcaaaactgaggggcatttt

SEQ ID NO: 37658 - DNA, 21 bp, Homo sapiens
tcaaaactgaggggcattttc

SEQ ID NO: 37659 - DNA, 23 bp, Homo sapiens
tcaaaactgaggggcattttctg

SEQ ID NO: 37660 - DNA, 24 bp, Homo sapiens
tcaaaactgaggggcattttctgt

SEQ ID NO: 37661 - DNA, 20 bp, Homo sapiens
aaaactgaggggcattttct

SEQ ID NO: 37662 - DNA, 18 bp, Homo sapiens
aggggcattttctgtggt

SEQ ID NO: 37663 - DNA, 17 bp, Homo sapiens
tttcaagccagggggcg

SEQ ID NO: 37664 - DNA, 20 bp, Homo sapiens
tttcaagccagggggcgttt

SEQ ID NO: 37665 - DNA, 21 bp, Homo sapiens
tttcaagccagggggcgtttt

SEQ ID NO: 37666 - DNA, 22 bp, Homo sapiens
tttcaagccagggggcgttttt

SEQ ID NO: 37667 - DNA, 24 bp, Homo sapiens
tttcaagccagggggcgtttttct

SEQ ID NO: 37668 - DNA, 23 bp, Homo sapiens
ttcaagccagggggcgtttttct

SEQ ID NO: 37669 - DNA, 17 bp, Homo sapiens
agggggcgtttttctat

SEQ ID NO: 37670 - DNA, 22 bp, Homo sapiens
aaagtgcttcctttttgagggt

SEQ ID NO: 37671 - DNA, 26 bp, Homo sapiens
aaagtgcttcctttttgagggttact

SEQ ID NO: 37672 - DNA, 21 bp, Homo sapiens
ttctccaaaagggagcacttt

SEQ ID NO: 37673 - DNA, 23 bp, Homo sapiens
ttctccaaaagggagcactttct

SEQ ID NO: 37674 - DNA, 22 bp, Homo sapiens
caaagtgcctccttttagagtg

SEQ ID NO: 37675 - DNA, 23 bp, Homo sapiens
caaagtgcctccttttagagtgt

SEQ ID NO: 37676 - DNA, 20 bp, Homo sapiens
aaagtgcctccttttagagt

SEQ ID NO: 37677 - DNA, 24 bp, Homo sapiens
aaagtgcctccttttagagtgtta

SEQ ID NO: 37678 - DNA, 23 bp, Homo sapiens
aagtgcctccttttagagtgtta

SEQ ID NO: 37679 - DNA, 19 bp, Homo sapiens
caagtgcttccttttagag

SEQ ID NO: 37680 - DNA, 21 bp, Homo sapiens
caagtgcttccttttagaggg

SEQ ID NO: 37681 - DNA, 22 bp, Homo sapiens
caagtgcttccttttagagggt

SEQ ID NO: 37682 - DNA, 23 bp, Homo sapiens
caagtgcttccttttagagggtt

SEQ ID NO: 37683 - DNA, 24 bp, Homo sapiens
caagtgcttccttttagagggtta

SEQ ID NO: 37684 - DNA, 26 bp, Homo sapiens
caagtgcttccttttagagggttacc

SEQ ID NO: 37685 - DNA, 27 bp, Homo sapiens
caagtgcttccttttagagggttaccg

SEQ ID NO: 37686 - DNA, 19 bp, Homo sapiens
aaagtgcatctttttagag

SEQ ID NO: 37687 - DNA, 20 bp, Homo sapiens
aaagtgcatctttttagagg

SEQ ID NO: 37688 - DNA, 21 bp, Homo sapiens
aaagtgcatctttttagagga

SEQ ID NO: 37689 - DNA, 23 bp, Homo sapiens
aaagtgcatctttttagaggatt

SEQ ID NO: 37690 - DNA, 25 bp, Homo sapiens
aaagtgcatctttttagaggattac

SEQ ID NO: 37691 - DNA, 27 bp, Homo sapiens
aaagtgcatctttttagaggattacag

SEQ ID NO: 37692 - DNA, 19 bp, Homo sapiens
ctccagagggaagtacttt

SEQ ID NO: 37693 - DNA, 20 bp, Homo sapiens
ctccagagggaagtactttc

SEQ ID NO: 37694 - DNA, 22 bp, Homo sapiens
ctccagagggaagtactttctg

SEQ ID NO: 37695 - DNA, 22 bp, Homo sapiens
gaaagtgcttccctttggactg

SEQ ID NO: 37696 - DNA, 20 bp, Homo sapiens
aaagtgcttccctttggact

SEQ ID NO: 37697 - DNA, 21 bp, Homo sapiens
aaagtgcttccctttggactg

SEQ ID NO: 37698 - DNA, 23 bp, Homo sapiens
aaagtgcttccctttggactgtt

SEQ ID NO: 37699 - DNA, 24 bp, Homo sapiens
aaagtgcttccctttggactgttt

SEQ ID NO: 37700 - DNA, 25 bp, Homo sapiens
aaagtgcttccctttggactgtttc

SEQ ID NO: 37701 - DNA, 19 bp, Homo sapiens
aagtgcttccctttggact

SEQ ID NO: 37702 - DNA, 18 bp, Homo sapiens
agtgcttccctttggact

SEQ ID NO: 37703 - DNA, 17 bp, Homo sapiens
ctcttgagggaagcact

SEQ ID NO: 37704 - DNA, 18 bp, Homo sapiens
ctcttgagggaagcactt

SEQ ID NO: 37705 - DNA, 22 bp, Homo sapiens
ctcttgagggaagcactttctg

SEQ ID NO: 37706 - DNA, 24 bp, Homo sapiens
ctcttgagggaagcactttctgtt

SEQ ID NO: 37707 - DNA, 25 bp, Homo sapiens
ctcttgagggaagcactttctgttg

SEQ ID NO: 37708 - DNA, 23 bp, Homo sapiens
aaagtgcttccttttagaggctt

SEQ ID NO: 37709 - DNA, 25 bp, Homo sapiens
aaagtgcttccttttagaggcttac

SEQ ID NO: 37710 - DNA, 17 bp, Homo sapiens
cttttagaggcttactg

SEQ ID NO: 37711 - DNA, 22 bp, Homo sapiens
agaaagtgcatccttttagagg

SEQ ID NO: 37712 - DNA, 23 bp, Homo sapiens
aaagtgcatccttttagaggttt

SEQ ID NO: 37713 - DNA, 24 bp, Homo sapiens
aaagtgcatccttttagaggttta

SEQ ID NO: 37714 - DNA, 21 bp, Homo sapiens
aagtgcatccttttagaggtt

SEQ ID NO: 37715 - DNA, 18 bp, Homo sapiens
ctccagagggatgcactt

SEQ ID NO: 37716 - DNA, 19 bp, Homo sapiens
ctccagagggatgcacttt

SEQ ID NO: 37717 - DNA, 20 bp, Homo sapiens
ctccagagggatgcactttc

SEQ ID NO: 37718 - DNA, 22 bp, Homo sapiens
ctccagagggatgcactttctc

SEQ ID NO: 37719 - DNA, 23 bp, Homo sapiens
ctccagagggatgcactttctct

SEQ ID NO: 37720 - DNA, 25 bp, Homo sapiens
ctccagagggatgcactttctctta

SEQ ID NO: 37721 - DNA, 21 bp, Homo sapiens
gaaggcgcttccctttagagc

SEQ ID NO: 37722 - DNA, 23 bp, Homo sapiens
gaaggcgcttccctttagagcgt

SEQ ID NO: 37723 - DNA, 24 bp, Homo sapiens
gaaggcgcttccctttagagcgtt

SEQ ID NO: 37724 - DNA, 22 bp, Homo sapiens
aaggcgcttccctttagagcgt

SEQ ID NO: 37725 - DNA, 19 bp, Homo sapiens
gaacgcgcttccctataga

SEQ ID NO: 37726 - DNA, 21 bp, Homo sapiens
gaacgcgcttccctatagagg

SEQ ID NO: 37727 - DNA, 19 bp, Homo sapiens
aacgcgcttccctatagag

SEQ ID NO: 37728 - DNA, 20 bp, Homo sapiens
aacgcgcttccctatagagg

SEQ ID NO: 37729 - DNA, 21 bp, Homo sapiens
aacgcgcttccctatagaggg

SEQ ID NO: 37730 - DNA, 22 bp, Homo sapiens
aacgcgcttccctatagagggt

SEQ ID NO: 37731 - DNA, 23 bp, Homo sapiens
aacgcgcttccctatagagggtt

SEQ ID NO: 37732 - DNA, 26 bp, Homo sapiens
aacgcgcttccctatagagggttacc

SEQ ID NO: 37733 - DNA, 25 bp, Homo sapiens
acgcgcttccctatagagggttacc

SEQ ID NO: 37734 - DNA, 25 bp, Homo sapiens
ctctagagggaagcactttctcttg

SEQ ID NO: 37735 - DNA, 24 bp, Homo sapiens
tctagagggaagcactttctcttg

SEQ ID NO: 37736 - DNA, 19 bp, Homo sapiens
gaaagcgcttctctttaga

SEQ ID NO: 37737 - DNA, 20 bp, Homo sapiens
gaaagcgcttctctttagag

SEQ ID NO: 37738 - DNA, 22 bp, Homo sapiens
gaaagcgcttctctttagagga

SEQ ID NO: 37739 - DNA, 23 bp, Homo sapiens
gaaagcgcttctctttagaggat

SEQ ID NO: 37740 - DNA, 24 bp, Homo sapiens
gaaagcgcttctctttagaggatt

SEQ ID NO: 37741 - DNA, 27 bp, Homo sapiens
gaaagcgcttctctttagaggattact

SEQ ID NO: 37742 - DNA, 21 bp, Homo sapiens
aaagcgcttctctttagagga

SEQ ID NO: 37743 - DNA, 23 bp, Homo sapiens
aaagcgcttctctttagaggatt

SEQ ID NO: 37744 - DNA, 20 bp, Homo sapiens
aagcgcttctctttagagga

SEQ ID NO: 37745 - DNA, 19 bp, Homo sapiens
caaagcgctcccctttaga

SEQ ID NO: 37746 - DNA, 20 bp, Homo sapiens
caaagcgctcccctttagag

SEQ ID NO: 37747 - DNA, 21 bp, Homo sapiens
caaagcgctcccctttagagg

SEQ ID NO: 37748 - DNA, 23 bp, Homo sapiens
caaagcgctcccctttagaggtt

SEQ ID NO: 37749 - DNA, 24 bp, Homo sapiens
caaagcgctcccctttagaggttt

SEQ ID NO: 37750 - DNA, 27 bp, Homo sapiens
caaagcgctcccctttagaggtttacg

SEQ ID NO: 37751 - DNA, 21 bp, Homo sapiens
aaagcgctcccctttagaggt

SEQ ID NO: 37752 - DNA, 26 bp, Homo sapiens
aaagcgctcccctttagaggtttacg

SEQ ID NO: 37753 - DNA, 21 bp, Homo sapiens
ctctggagggaagcactttct

SEQ ID NO: 37754 - DNA, 22 bp, Homo sapiens
ctctggagggaagcactttctg

SEQ ID NO: 37755 - DNA, 23 bp, Homo sapiens
ctctggagggaagcactttctgt

SEQ ID NO: 37756 - DNA, 24 bp, Homo sapiens
ctctggagggaagcactttctgtt

SEQ ID NO: 37757 - DNA, 22 bp, Homo sapiens
acaaagcgcttctctttagagt

SEQ ID NO: 37758 - DNA, 18 bp, Homo sapiens
caaagcgcttctctttag

SEQ ID NO: 37759 - DNA, 19 bp, Homo sapiens
caaagcgcttctctttaga

SEQ ID NO: 37760 - DNA, 21 bp, Homo sapiens
caaagcgcttctctttagagt

SEQ ID NO: 37761 - DNA, 22 bp, Homo sapiens
caaagcgcttctctttagagtg

SEQ ID NO: 37762 - DNA, 24 bp, Homo sapiens
caaagcgcttctctttagagtgtt

SEQ ID NO: 37763 - DNA, 25 bp, Homo sapiens
caaagcgcttctctttagagtgtta

SEQ ID NO: 37764 - DNA, 27 bp, Homo sapiens
caaagcgcttctctttagagtgttacg

SEQ ID NO: 37765 - DNA, 26 bp, Homo sapiens
aaagcgcttctctttagagtgttacg

SEQ ID NO: 37766 - DNA, 19 bp, Homo sapiens
ctacaaagggaagcacttt

SEQ ID NO: 37767 - DNA, 20 bp, Homo sapiens
ctacaaagggaagcactttc

SEQ ID NO: 37768 - DNA, 21 bp, Homo sapiens
ctacaaagggaagcactttct

SEQ ID NO: 37769 - DNA, 23 bp, Homo sapiens
ctacaaagggaagcactttctct

SEQ ID NO: 37770 - DNA, 22 bp, Homo sapiens
gaaggcgcttccctttggagtg

SEQ ID NO: 37771 - DNA, 23 bp, Homo sapiens
gaaggcgcttccctttggagtgt

SEQ ID NO: 37772 - DNA, 26 bp, Homo sapiens
gaaggcgcttccctttggagtgttac

SEQ ID NO: 37773 - DNA, 21 bp, Homo sapiens
aaggcgcttccctttggagtg

SEQ ID NO: 37774 - DNA, 22 bp, Homo sapiens
cctccaaagggaagcgctttct

SEQ ID NO: 37775 - DNA, 23 bp, Homo sapiens
cctccaaagggaagcgctttctg

SEQ ID NO: 37776 - DNA, 24 bp, Homo sapiens
cctccaaagggaagcgctttctgt

SEQ ID NO: 37777 - DNA, 23 bp, Homo sapiens
acaaagtgcctccctttagagtg

SEQ ID NO: 37778 - DNA, 17 bp, Homo sapiens
caaagtgcctcccttta

SEQ ID NO: 37779 - DNA, 19 bp, Homo sapiens
caaagtgcctccctttaga

SEQ ID NO: 37780 - DNA, 20 bp, Homo sapiens
caaagtgcctccctttagag

SEQ ID NO: 37781 - DNA, 21 bp, Homo sapiens
caaagtgcctccctttagagt

SEQ ID NO: 37782 - DNA, 23 bp, Homo sapiens
caaagtgcctccctttagagtgt

SEQ ID NO: 37783 - DNA, 24 bp, Homo sapiens
caaagtgcctccctttagagtgtt

SEQ ID NO: 37784 - DNA, 26 bp, Homo sapiens
caaagtgcctccctttagagtgttac

SEQ ID NO: 37785 - DNA, 27 bp, Homo sapiens
caaagtgcctccctttagagtgttacc

SEQ ID NO: 37786 - DNA, 28 bp, Homo sapiens
caaagtgcctccctttagagtgttaccg

SEQ ID NO: 37787 - DNA, 22 bp, Homo sapiens
tctacaaagggaagccctttct

SEQ ID NO: 37788 - DNA, 21 bp, Homo sapiens
ctacaaagggaagccctttct

SEQ ID NO: 37789 - DNA, 22 bp, Homo sapiens
ctacaaagggaagccctttctg

SEQ ID NO: 37790 - DNA, 23 bp, Homo sapiens
ctacaaagggaagccctttctgt

SEQ ID NO: 37791 - DNA, 25 bp, Homo sapiens
ctacaaagggaagccctttctgttg

SEQ ID NO: 37792 - DNA, 20 bp, Homo sapiens
aaagaaagtgcttctctttg

SEQ ID NO: 37793 - DNA, 20 bp, Homo sapiens
aaagtgcttctctttggtgg

SEQ ID NO: 37794 - DNA, 21 bp, Homo sapiens
aaagtgcttctctttggtggg

SEQ ID NO: 37795 - DNA, 23 bp, Homo sapiens
aaagtgcttctctttggtgggtt

SEQ ID NO: 37796 - DNA, 24 bp, Homo sapiens
aaagtgcttctctttggtgggtta

SEQ ID NO: 37797 - DNA, 23 bp, Homo sapiens
aagtgcttctctttggtgggtta

SEQ ID NO: 37798 - DNA, 21 bp, Homo sapiens
agtgcttctctttggtgggtt

SEQ ID NO: 37799 - DNA, 23 bp, Homo sapiens
acaaagtgcttccctttagagtg

SEQ ID NO: 37800 - DNA, 22 bp, Homo sapiens
caaagtgcttccctttagagtg

SEQ ID NO: 37801 - DNA, 23 bp, Homo sapiens
caaagtgcttccctttagagtgt

SEQ ID NO: 37802 - DNA, 26 bp, Homo sapiens
caaagtgcttccctttagagtgttac

SEQ ID NO: 37803 - DNA, 28 bp, Homo sapiens
caaagtgcttccctttagagtgttaccg

SEQ ID NO: 37804 - DNA, 18 bp, Homo sapiens
tgcttccctttagagtgt

SEQ ID NO: 37805 - DNA, 17 bp, Homo sapiens
gtgaccatctggaggta

SEQ ID NO: 37806 - DNA, 26 bp, Homo sapiens
ccatctggaggtaagaagcactttgt

SEQ ID NO: 37807 - DNA, 24 bp, Homo sapiens
catctggaggtaagaagcactttg

SEQ ID NO: 37808 - DNA, 25 bp, Homo sapiens
catctggaggtaagaagcactttgt

SEQ ID NO: 37809 - DNA, 23 bp, Homo sapiens
atctggaggtaagaagcactttg

SEQ ID NO: 37810 - DNA, 24 bp, Homo sapiens
atctggaggtaagaagcactttgt

SEQ ID NO: 37811 - DNA, 21 bp, Homo sapiens
gaaagcgcttcccttcagagt

SEQ ID NO: 37812 - DNA, 22 bp, Homo sapiens
gaaagcgcttcccttcagagtg

SEQ ID NO: 37813 - DNA, 23 bp, Homo sapiens
gaaagcgcttcccttcagagtgt

SEQ ID NO: 37814 - DNA, 20 bp, Homo sapiens
aaagcgcttcccttcagagt

SEQ ID NO: 37815 - DNA, 22 bp, Homo sapiens
aaagcgcttcccttcagagtgt

SEQ ID NO: 37816 - DNA, 23 bp, Homo sapiens
aaagcgcttcccttcagagtgtt

SEQ ID NO: 37817 - DNA, 20 bp, Homo sapiens
aagcgcttcccttcagagtg

SEQ ID NO: 37818 - DNA, 21 bp, Homo sapiens
aagcgcttcccttcagagtgt

SEQ ID NO: 37819 - DNA, 22 bp, Homo sapiens
caaagcgcttccctttggagcg

SEQ ID NO: 37820 - DNA, 24 bp, Homo sapiens
caaagcgcttccctttggagcgtt

SEQ ID NO: 37821 - DNA, 27 bp, Homo sapiens
caaagcgcttccctttggagcgttacg

SEQ ID NO: 37822 - DNA, 25 bp, Homo sapiens
ccatctggaggtaagaagcactttc

SEQ ID NO: 37823 - DNA, 23 bp, Homo sapiens
atctggaggtaagaagcactttc

SEQ ID NO: 37824 - DNA, 24 bp, Homo sapiens
atctggaggtaagaagcactttct

SEQ ID NO: 37825 - DNA, 25 bp, Homo sapiens
atctggaggtaagaagcactttctg

SEQ ID NO: 37826 - DNA, 26 bp, Homo sapiens
atctggaggtaagaagcactttctgt

SEQ ID NO: 37827 - DNA, 22 bp, Homo sapiens
tctggaggtaagaagcactttc

SEQ ID NO: 37828 - DNA, 19 bp, Homo sapiens
tctgcaaagggaagccctt

SEQ ID NO: 37829 - DNA, 23 bp, Homo sapiens
tctgcaaagggaagccctttctg

SEQ ID NO: 37830 - DNA, 24 bp, Homo sapiens
tctgcaaagggaagccctttctgt

SEQ ID NO: 37831 - DNA, 18 bp, Homo sapiens
atcgtgcatccttttaga

SEQ ID NO: 37832 - DNA, 19 bp, Homo sapiens
atcgtgcatccttttagag

SEQ ID NO: 37833 - DNA, 20 bp, Homo sapiens
atcgtgcatccttttagagt

SEQ ID NO: 37834 - DNA, 21 bp, Homo sapiens
atcgtgcatccttttagagtg

SEQ ID NO: 37835 - DNA, 23 bp, Homo sapiens
atcgtgcatccttttagagtgtt

SEQ ID NO: 37836 - DNA, 25 bp, Homo sapiens
atcgtgcatccttttagagtgttac

SEQ ID NO: 37837 - DNA, 20 bp, Homo sapiens
tcgtgcatccttttagagtg

SEQ ID NO: 37838 - DNA, 21 bp, Homo sapiens
tcgtgcatccttttagagtgt

SEQ ID NO: 37839 - DNA, 22 bp, Homo sapiens
tcgtgcatccttttagagtgtt

SEQ ID NO: 37840 - DNA, 23 bp, Homo sapiens
tcgtgcatccttttagagtgtta

SEQ ID NO: 37841 - DNA, 24 bp, Homo sapiens
tcgtgcatccttttagagtgttac

SEQ ID NO: 37842 - DNA, 24 bp, Homo sapiens
acaaagtgcttccctttagagtta

SEQ ID NO: 37843 - DNA, 25 bp, Homo sapiens
acaaagtgcttccctttagagttac

SEQ ID NO: 37844 - DNA, 23 bp, Homo sapiens
caaagtgcttccctttagagtta

SEQ ID NO: 37845 - DNA, 24 bp, Homo sapiens
tccctctagagggaagcgctttct

SEQ ID NO: 37846 - DNA, 17 bp, Homo sapiens
aaaatggttccctttag

SEQ ID NO: 37847 - DNA, 18 bp, Homo sapiens
aaaatggttccctttaga

SEQ ID NO: 37848 - DNA, 19 bp, Homo sapiens
aaaatggttccctttagag

SEQ ID NO: 37849 - DNA, 20 bp, Homo sapiens
aaaatggttccctttagagt

SEQ ID NO: 37850 - DNA, 21 bp, Homo sapiens
aaaatggttccctttagagtg

SEQ ID NO: 37851 - DNA, 23 bp, Homo sapiens
aaaatggttccctttagagtgtt

SEQ ID NO: 37852 - DNA, 26 bp, Homo sapiens
aaaatggttccctttagagtgttacg

SEQ ID NO: 37853 - DNA, 16 bp, Homo sapiens
actctagagggaagcg

SEQ ID NO: 37854 - DNA, 18 bp, Homo sapiens
actctagagggaagcgct

SEQ ID NO: 37855 - DNA, 19 bp, Homo sapiens
actctagagggaagcgctt

SEQ ID NO: 37856 - DNA, 20 bp, Homo sapiens
actctagagggaagcgcttt

SEQ ID NO: 37857 - DNA, 21 bp, Homo sapiens
actctagagggaagcgctttc

SEQ ID NO: 37858 - DNA, 22 bp, Homo sapiens
actctagagggaagcgctttct

SEQ ID NO: 37859 - DNA, 23 bp, Homo sapiens
actctagagggaagcgctttctg

SEQ ID NO: 37860 - DNA, 23 bp, Homo sapiens
tgcccccacagtttgagtgccac

SEQ ID NO: 37861 - DNA, 25 bp, Homo sapiens
agtgcccccacagtttgagtgccac

SEQ ID NO: 37862 - DNA, 22 bp, Homo sapiens
tgcccccacagtttgagtgcca

SEQ ID NO: 37863 - DNA, 25 bp, Homo sapiens
aagtgcccccacagtttgagtgcca

SEQ ID NO: 37864 - DNA, 21 bp, Homo sapiens
tgcccccacagtttgagtgcc

SEQ ID NO: 37865 - DNA, 22 bp, Homo sapiens
gtgcccccacagtttgagtgcc

SEQ ID NO: 37866 - DNA, 23 bp, Homo sapiens
agtgcccccacagtttgagtgcc

SEQ ID NO: 37867 - DNA, 24 bp, Homo sapiens
aagtgcccccacagtttgagtgcc

SEQ ID NO: 37868 - DNA, 20 bp, Homo sapiens
tgcccccacagtttgagtgc

SEQ ID NO: 37869 - DNA, 22 bp, Homo sapiens
agtgcccccacagtttgagtgc

SEQ ID NO: 37870 - DNA, 20 bp, Homo sapiens
gtgcccccacagtttgagtg

SEQ ID NO: 37871 - DNA, 22 bp, Homo sapiens
aagtgcccccacagtttgagtg

SEQ ID NO: 37872 - DNA, 19 bp, Homo sapiens
actcaaactgtgggggcac

SEQ ID NO: 37873 - DNA, 20 bp, Homo sapiens
agtgcccccacagtttgagt

SEQ ID NO: 37874 - DNA, 21 bp, Homo sapiens
actcaaactgtgggggcactt

SEQ ID NO: 37875 - DNA, 22 bp, Homo sapiens
actcaaactgtgggggcacttt

SEQ ID NO: 37876 - DNA, 23 bp, Homo sapiens
actcaaactgtgggggcactttc

SEQ ID NO: 37877 - DNA, 26 bp, Homo sapiens
actcaaaagatggcggcactttcacc

SEQ ID NO: 37878 - DNA, 24 bp, Homo sapiens
actcaaaagatggcggcactttca

SEQ ID NO: 37879 - DNA, 23 bp, Homo sapiens
actcaaaagatggcggcactttc

SEQ ID NO: 37880 - DNA, 24 bp, Homo sapiens
cactcaaaagatggcggcactttc

SEQ ID NO: 37881 - DNA, 25 bp, Homo sapiens
acactcaaaagatggcggcactttc

SEQ ID NO: 37882 - DNA, 25 bp, Homo sapiens
gaaagtgccgccatcttttgagtgt

SEQ ID NO: 37883 - DNA, 23 bp, Homo sapiens
cactcaaaagatggcggcacttt

SEQ ID NO: 37884 - DNA, 21 bp, Homo sapiens
actcaaaagatggcggcactt

SEQ ID NO: 37885 - DNA, 22 bp, Homo sapiens
cactcaaaagatggcggcactt

SEQ ID NO: 37886 - DNA, 22 bp, Homo sapiens
aagtgccgccatcttttgagtg

SEQ ID NO: 37887 - DNA, 21 bp, Homo sapiens
cactcaaaagatggcggcact

SEQ ID NO: 37888 - DNA, 22 bp, Homo sapiens
acactcaaaagatggcggcact

SEQ ID NO: 37889 - DNA, 22 bp, Homo sapiens
agtgccgccatcttttgagtgt

SEQ ID NO: 37890 - DNA, 21 bp, Homo sapiens
gtgccgccatcttttgagtgt

SEQ ID NO: 37891 - DNA, 18 bp, Homo sapiens
cactcaaaagatggcggc

SEQ ID NO: 37892 - DNA, 16 bp, Homo sapiens
cactcaaaagatggcg

SEQ ID NO: 37893 - DNA, 21 bp, Homo sapiens
cctcaaatgtggagcactatt

SEQ ID NO: 37894 - DNA, 22 bp, Homo sapiens
cctcaaatgtggagcactattc

SEQ ID NO: 37895 - DNA, 21 bp, Homo sapiens
aaagtgctgcgacatttgagc

SEQ ID NO: 37896 - DNA, 22 bp, Homo sapiens
aaagtgctgcgacatttgagcg

SEQ ID NO: 37897 - DNA, 25 bp, Homo sapiens
aaagtgctgcgacatttgagcgtca

SEQ ID NO: 37898 - DNA, 27 bp, Homo sapiens
aaagtgctgcgacatttgagcgtcacc

SEQ ID NO: 37899 - DNA, 21 bp, Homo sapiens
aagtgctgcgacatttgagcg

SEQ ID NO: 37900 - DNA, 22 bp, Homo sapiens
aagtgctgcgacatttgagcgt

SEQ ID NO: 37901 - DNA, 26 bp, Homo sapiens
aagtgctgcgacatttgagcgtcacc

SEQ ID NO: 37902 - DNA, 21 bp, Homo sapiens
tactcaaaatgggggcgcttt

SEQ ID NO: 37903 - DNA, 22 bp, Homo sapiens
tactcaaaatgggggcgctttc

SEQ ID NO: 37904 - DNA, 20 bp, Homo sapiens
actcaaaatgggggcgcttt

SEQ ID NO: 37905 - DNA, 21 bp, Homo sapiens
actcaaaatgggggcgctttc

SEQ ID NO: 37906 - DNA, 17 bp, Homo sapiens
gaagtgcttcgattttg

SEQ ID NO: 37907 - DNA, 19 bp, Homo sapiens
gaagtgcttcgattttggg

SEQ ID NO: 37908 - DNA, 20 bp, Homo sapiens
gaagtgcttcgattttgggg

SEQ ID NO: 37909 - DNA, 21 bp, Homo sapiens
gaagtgcttcgattttggggt

SEQ ID NO: 37910 - DNA, 22 bp, Homo sapiens
gaagtgcttcgattttggggtg

SEQ ID NO: 37911 - DNA, 24 bp, Homo sapiens
gaagtgcttcgattttggggtgtc

SEQ ID NO: 37912 - DNA, 25 bp, Homo sapiens
gaagtgcttcgattttggggtgtcc

SEQ ID NO: 37913 - DNA, 18 bp, Homo sapiens
aagtgcttcgattttggg

SEQ ID NO: 37914 - DNA, 19 bp, Homo sapiens
ccagttaccgcttccgcta

SEQ ID NO: 37915 - DNA, 21 bp, Homo sapiens
ccagttaccgcttccgctacc

SEQ ID NO: 37916 - DNA, 22 bp, Homo sapiens
ccagttaccgcttccgctaccg

SEQ ID NO: 37917 - DNA, 19 bp, Homo sapiens
cagttaccgcttccgctac

SEQ ID NO: 37918 - DNA, 20 bp, Homo sapiens
cagttaccgcttccgctacc

SEQ ID NO: 37919 - DNA, 21 bp, Homo sapiens
cagttaccgcttccgctaccg

SEQ ID NO: 37920 - DNA, 22 bp, Homo sapiens
cagttaccgcttccgctaccgc

SEQ ID NO: 37921 - DNA, 23 bp, Homo sapiens
cagttaccgcttccgctaccgcc

SEQ ID NO: 37922 - DNA, 25 bp, Homo sapiens
cgcacctgcctctcacccacagtgc

SEQ ID NO: 37923 - DNA, 23 bp, Homo sapiens
gcacctgcctctcacccacagtg

SEQ ID NO: 37924 - DNA, 24 bp, Homo sapiens
cgcacctgcctctcacccacagtg

SEQ ID NO: 37925 - DNA, 22 bp, Homo sapiens
gcacctgcctctcacccacagt

SEQ ID NO: 37926 - DNA, 23 bp, Homo sapiens
cgcacctgcctctcacccacagt

SEQ ID NO: 37927 - DNA, 21 bp, Homo sapiens
gcacctgcctctcacccacag

SEQ ID NO: 37928 - DNA, 21 bp, Homo sapiens
cgcacctgcctctcacccaca

SEQ ID NO: 37929 - DNA, 26 bp, Homo sapiens
acagccgcacctgcctctcacccaca

SEQ ID NO: 37930 - DNA, 20 bp, Homo sapiens
cgcacctgcctctcacccac

SEQ ID NO: 37931 - DNA, 25 bp, Homo sapiens
gagggtgtcagcaggtgacggtggg

SEQ ID NO: 37932 - DNA, 26 bp, Homo sapiens
tgagggtgtcagcaggtgacggtggg

SEQ ID NO: 37933 - DNA, 23 bp, Homo sapiens
agggtgtcagcaggtgacggtgg

SEQ ID NO: 37934 - DNA, 25 bp, Homo sapiens
tgagggtgtcagcaggtgacggtgg

SEQ ID NO: 37935 - DNA, 22 bp, Homo sapiens
agggtgtcagcaggtgacggtg

SEQ ID NO: 37936 - DNA, 23 bp, Homo sapiens
gagggtgtcagcaggtgacggtg

SEQ ID NO: 37937 - DNA, 24 bp, Homo sapiens
tgagggtgtcagcaggtgacggtg

SEQ ID NO: 37938 - DNA, 21 bp, Homo sapiens
agggtgtcagcaggtgacggt

SEQ ID NO: 37939 - DNA, 23 bp, Homo sapiens
tgagggtgtcagcaggtgacggt

SEQ ID NO: 37940 - DNA, 24 bp, Homo sapiens
gtgagggtgtcagcaggtgacggt

SEQ ID NO: 37941 - DNA, 22 bp, Homo sapiens
tgagggtgtcagcaggtgacgg

SEQ ID NO: 37942 - DNA, 23 bp, Homo sapiens
gtgagggtgtcagcaggtgacgg

SEQ ID NO: 37943 - DNA, 20 bp, Homo sapiens
gagggtgtcagcaggtgacg

SEQ ID NO: 37944 - DNA, 22 bp, Homo sapiens
gtgagggtgtcagcaggtgacg

SEQ ID NO: 37945 - DNA, 20 bp, Homo sapiens
tgagggtgtcagcaggtgac

SEQ ID NO: 37946 - DNA, 19 bp, Homo sapiens
tgagggtgtcagcaggtga

SEQ ID NO: 37947 - DNA, 20 bp, Homo sapiens
gtgagggtgtcagcaggtga

SEQ ID NO: 37948 - DNA, 18 bp, Homo sapiens
tgagggtgtcagcaggtg

SEQ ID NO: 37949 - DNA, 20 bp, Homo sapiens
ccctctcacctaagcagagc

SEQ ID NO: 37950 - DNA, 25 bp, Homo sapiens
ttcacccctctcacctaagcagagc

SEQ ID NO: 37951 - DNA, 26 bp, Homo sapiens
cttcacccctctcacctaagcagagc

SEQ ID NO: 37952 - DNA, 27 bp, Homo sapiens
tcttcacccctctcacctaagcagagc

SEQ ID NO: 37953 - DNA, 18 bp, Homo sapiens
ccctctcacctaagcaga

SEQ ID NO: 37954 - DNA, 23 bp, Homo sapiens
ttcacccctctcacctaagcaga

SEQ ID NO: 37955 - DNA, 24 bp, Homo sapiens
cttcacccctctcacctaagcaga

SEQ ID NO: 37956 - DNA, 17 bp, Homo sapiens
ccctctcacctaagcag

SEQ ID NO: 37957 - DNA, 23 bp, Homo sapiens
cttcacccctctcacctaagcag

SEQ ID NO: 37958 - DNA, 21 bp, Homo sapiens
ttcacccctctcacctaagca

SEQ ID NO: 37959 - DNA, 22 bp, Homo sapiens
cttcacccctctcacctaagca

SEQ ID NO: 37960 - DNA, 21 bp, Homo sapiens
cttcacccctctcacctaagc

SEQ ID NO: 37961 - DNA, 22 bp, Homo sapiens
tcttcacccctctcacctaagc

SEQ ID NO: 37962 - DNA, 20 bp, Homo sapiens
cttcacccctctcacctaag

SEQ ID NO: 37963 - DNA, 21 bp, Homo sapiens
tcttcacccctctcacctaag

SEQ ID NO: 37964 - DNA, 19 bp, Homo sapiens
cttcacccctctcacctaa

SEQ ID NO: 37965 - DNA, 20 bp, Homo sapiens
tcttcacccctctcacctaa

SEQ ID NO: 37966 - DNA, 22 bp, Homo sapiens
acgtcttcacccctctcaccta

SEQ ID NO: 37967 - DNA, 22 bp, Homo sapiens
ggtggggggcttgaagccccga

SEQ ID NO: 37968 - DNA, 24 bp, Homo sapiens
ctaggtggggggcttgaagccccg

SEQ ID NO: 37969 - DNA, 21 bp, Homo sapiens
taggtggggggcttgaagccc

SEQ ID NO: 37970 - DNA, 22 bp, Homo sapiens
ctaggtggggggcttgaagccc

SEQ ID NO: 37971 - DNA, 20 bp, Homo sapiens
taggtggggggcttgaagcc

SEQ ID NO: 37972 - DNA, 21 bp, Homo sapiens
ctaggtggggggcttgaagcc

SEQ ID NO: 37973 - DNA, 22 bp, Homo sapiens
gctaggtggggggcttgaagcc

SEQ ID NO: 37974 - DNA, 19 bp, Homo sapiens
taggtggggggcttgaagc

SEQ ID NO: 37975 - DNA, 21 bp, Homo sapiens
gctaggtggggggcttgaagc

SEQ ID NO: 37976 - DNA, 22 bp, Homo sapiens
ggctaggtggggggcttgaagc

SEQ ID NO: 37977 - DNA, 19 bp, Homo sapiens
ctaggtggggggcttgaag

SEQ ID NO: 37978 - DNA, 20 bp, Homo sapiens
gctaggtggggggcttgaag

SEQ ID NO: 37979 - DNA, 18 bp, Homo sapiens
ctaggtggggggcttgaa

SEQ ID NO: 37980 - DNA, 19 bp, Homo sapiens
gctaggtggggggcttgaa

SEQ ID NO: 37981 - DNA, 25 bp, Homo sapiens
tccctcgccttctcaccctcagtgg

SEQ ID NO: 37982 - DNA, 24 bp, Homo sapiens
tccctcgccttctcaccctcagtg

SEQ ID NO: 37983 - DNA, 23 bp, Homo sapiens
tccctcgccttctcaccctcagt

SEQ ID NO: 37984 - DNA, 20 bp, Homo sapiens
ccctcgccttctcaccctca

SEQ ID NO: 37985 - DNA, 21 bp, Homo sapiens
tccctcgccttctcaccctca

SEQ ID NO: 37986 - DNA, 20 bp, Homo sapiens
tccctcgccttctcaccctc

SEQ ID NO: 37987 - DNA, 26 bp, Homo sapiens
ctctgggggtggggggctgggcgtgg

SEQ ID NO: 37988 - DNA, 23 bp, Homo sapiens
tctgggggtggggggctgggcgt

SEQ ID NO: 37989 - DNA, 25 bp, Homo sapiens
cctctgggggtggggggctgggcgt

SEQ ID NO: 37990 - DNA, 22 bp, Homo sapiens
tctgggggtggggggctgggcg

SEQ ID NO: 37991 - DNA, 22 bp, Homo sapiens
ctctgggggtggggggctgggc

SEQ ID NO: 37992 - DNA, 19 bp, Homo sapiens
tagggggcggcttgtggag

SEQ ID NO: 37993 - DNA, 20 bp, Homo sapiens
tagggggcggcttgtggagt

SEQ ID NO: 37994 - DNA, 21 bp, Homo sapiens
tagggggcggcttgtggagtg

SEQ ID NO: 37995 - DNA, 23 bp, Homo sapiens
tagggggcggcttgtggagtgta

SEQ ID NO: 37996 - DNA, 24 bp, Homo sapiens
tagggggcggcttgtggagtgtat

SEQ ID NO: 37997 - DNA, 26 bp, Homo sapiens
tagggggcggcttgtggagtgtatgg

SEQ ID NO: 37998 - DNA, 18 bp, Homo sapiens
agggggcggcttgtggag

SEQ ID NO: 37999 - DNA, 20 bp, Homo sapiens
agggggcggcttgtggagtg

SEQ ID NO: 38000 - DNA, 23 bp, Homo sapiens
agggggcggcttgtggagtgtat

SEQ ID NO: 38001 - DNA, 25 bp, Homo sapiens
agggggcggcttgtggagtgtatgg

SEQ ID NO: 38002 - DNA, 27 bp, Homo sapiens
agggggcggcttgtggagtgtatgggc

SEQ ID NO: 38003 - DNA, 22 bp, Homo sapiens
ggggcggcttgtggagtgtatg

SEQ ID NO: 38004 - DNA, 25 bp, Homo sapiens
ggggcggcttgtggagtgtatgggc

SEQ ID NO: 38005 - DNA, 24 bp, Homo sapiens
tgagccttgctctgctcccccgcc

SEQ ID NO: 38006 - DNA, 24 bp, Homo sapiens
ttgctctgctcccccgcccccagg

SEQ ID NO: 38007 - DNA, 21 bp, Homo sapiens
ctctgctcccccgcccccagg

SEQ ID NO: 38008 - DNA, 20 bp, Homo sapiens
tctgctcccccgcccccagg

SEQ ID NO: 38009 - DNA, 21 bp, Homo sapiens
tctgctcccccgcccccaggc

SEQ ID NO: 38010 - DNA, 22 bp, Homo sapiens
tctgctcccccgcccccaggca

SEQ ID NO: 38011 - DNA, 28 bp, Homo sapiens
ctgtaggcatgaggcagggcccaggttc

SEQ ID NO: 38012 - DNA, 17 bp, Homo sapiens
tgtaggcatgaggcagg

SEQ ID NO: 38013 - DNA, 19 bp, Homo sapiens
tgtaggcatgaggcagggc

SEQ ID NO: 38014 - DNA, 23 bp, Homo sapiens
gtaggcatgaggcagggcccagg

SEQ ID NO: 38015 - DNA, 17 bp, Homo sapiens
tgaagctctgacattcc

SEQ ID NO: 38016 - DNA, 18 bp, Homo sapiens
tgaagctctgacattcct

SEQ ID NO: 38017 - DNA, 21 bp, Homo sapiens
tgaagctctgacattcctgca

SEQ ID NO: 38018 - DNA, 23 bp, Homo sapiens
tgaagctctgacattcctgcagg

SEQ ID NO: 38019 - DNA, 24 bp, Homo sapiens
tgaagctctgacattcctgcaggc

SEQ ID NO: 38020 - DNA, 20 bp, Homo sapiens
gaagctctgacattcctgca

SEQ ID NO: 38021 - DNA, 21 bp, Homo sapiens
gaagctctgacattcctgcag

SEQ ID NO: 38022 - DNA, 22 bp, Homo sapiens
gaagctctgacattcctgcagg

SEQ ID NO: 38023 - DNA, 23 bp, Homo sapiens
ggacctgggttagcggagtgagg

SEQ ID NO: 38024 - DNA, 22 bp, Homo sapiens
ggacctgggttagcggagtgag

SEQ ID NO: 38025 - DNA, 22 bp, Homo sapiens
cggacctgggttagcggagtga

SEQ ID NO: 38026 - DNA, 25 bp, Homo sapiens
atgcggacctgggttagcggagtga

SEQ ID NO: 38027 - DNA, 22 bp, Homo sapiens
tgcggacctgggttagcggagt

SEQ ID NO: 38028 - DNA, 21 bp, Homo sapiens
tgcggacctgggttagcggag

SEQ ID NO: 38029 - DNA, 22 bp, Homo sapiens
atgcggacctgggttagcggag

SEQ ID NO: 38030 - DNA, 21 bp, Homo sapiens
atgcggacctgggttagcgga

SEQ ID NO: 38031 - DNA, 25 bp, Homo sapiens
cctgatgcggacctgggttagcgga

SEQ ID NO: 38032 - DNA, 16 bp, Homo sapiens
atgcggacctgggtta

SEQ ID NO: 38033 - DNA, 19 bp, Homo sapiens
gtgagccagtggaatggag

SEQ ID NO: 38034 - DNA, 20 bp, Homo sapiens
gtgagccagtggaatggaga

SEQ ID NO: 38035 - DNA, 21 bp, Homo sapiens
gtgagccagtggaatggagag

SEQ ID NO: 38036 - DNA, 23 bp, Homo sapiens
gtgagccagtggaatggagaggc

SEQ ID NO: 38037 - DNA, 24 bp, Homo sapiens
gtgagccagtggaatggagaggct

SEQ ID NO: 38038 - DNA, 25 bp, Homo sapiens
gtgagccagtggaatggagaggctg

SEQ ID NO: 38039 - DNA, 20 bp, Homo sapiens
tgagccagtggaatggagag

SEQ ID NO: 38040 - DNA, 21 bp, Homo sapiens
tgagccagtggaatggagagg

SEQ ID NO: 38041 - DNA, 22 bp, Homo sapiens
tgagccagtggaatggagaggc

SEQ ID NO: 38042 - DNA, 24 bp, Homo sapiens
tgagccagtggaatggagaggctg

SEQ ID NO: 38043 - DNA, 16 bp, Homo sapiens
ttcatccactgcattc

SEQ ID NO: 38044 - DNA, 18 bp, Homo sapiens
ttcatccactgcattcct

SEQ ID NO: 38045 - DNA, 24 bp, Homo sapiens
tccactgcattcctgcttggccca

SEQ ID NO: 38046 - DNA, 19 bp, Homo sapiens
cactgcattcctgcttggc

SEQ ID NO: 38047 - DNA, 20 bp, Homo sapiens
cactgcattcctgcttggcc

SEQ ID NO: 38048 - DNA, 21 bp, Homo sapiens
cactgcattcctgcttggccc

SEQ ID NO: 38049 - DNA, 24 bp, Homo sapiens
cactgcattcctgcttggcccagg

SEQ ID NO: 38050 - DNA, 25 bp, Homo sapiens
cactgcattcctgcttggcccagga

SEQ ID NO: 38051 - DNA, 26 bp, Homo sapiens
cactgcattcctgcttggcccaggac

SEQ ID NO: 38052 - DNA, 23 bp, Homo sapiens
actgcattcctgcttggcccagg

SEQ ID NO: 38053 - DNA, 21 bp, Homo sapiens
tgcattcctgcttggcccagg

SEQ ID NO: 38054 - DNA, 24 bp, Homo sapiens
ctttgcttcctgctcccctaggct

SEQ ID NO: 38055 - DNA, 22 bp, Homo sapiens
tttgcttcctgctcccctaggc

SEQ ID NO: 38056 - DNA, 23 bp, Homo sapiens
ctttgcttcctgctcccctaggc

SEQ ID NO: 38057 - DNA, 21 bp, Homo sapiens
tttgcttcctgctcccctagg

SEQ ID NO: 38058 - DNA, 22 bp, Homo sapiens
ctttgcttcctgctcccctagg

SEQ ID NO: 38059 - DNA, 23 bp, Homo sapiens
gctttgcttcctgctcccctagg

SEQ ID NO: 38060 - DNA, 20 bp, Homo sapiens
tttgcttcctgctcccctag

SEQ ID NO: 38061 - DNA, 19 bp, Homo sapiens
tttgcttcctgctccccta

SEQ ID NO: 38062 - DNA, 20 bp, Homo sapiens
ctttgcttcctgctccccta

SEQ ID NO: 38063 - DNA, 18 bp, Homo sapiens
tttgcttcctgctcccct

SEQ ID NO: 38064 - DNA, 20 bp, Homo sapiens
ggctttgcttcctgctcccc

SEQ ID NO: 38065 - DNA, 21 bp, Homo sapiens
tgcgcaagcaaagccagggac

SEQ ID NO: 38066 - DNA, 24 bp, Homo sapiens
gggggcactgcgcaagcaaagcca

SEQ ID NO: 38067 - DNA, 26 bp, Homo sapiens
gaggggggcactgcgcaagcaaagcc

SEQ ID NO: 38068 - DNA, 23 bp, Homo sapiens
ggggggcactgcgcaagcaaagc

SEQ ID NO: 38069 - DNA, 24 bp, Homo sapiens
aggggggcactgcgcaagcaaagc

SEQ ID NO: 38070 - DNA, 25 bp, Homo sapiens
gaggggggcactgcgcaagcaaagc

SEQ ID NO: 38071 - DNA, 23 bp, Homo sapiens
aggggggcactgcgcaagcaaag

SEQ ID NO: 38072 - DNA, 24 bp, Homo sapiens
gaggggggcactgcgcaagcaaag

SEQ ID NO: 38073 - DNA, 23 bp, Homo sapiens
gaggggggcactgcgcaagcaaa

SEQ ID NO: 38074 - DNA, 22 bp, Homo sapiens
gaggggggcactgcgcaagcaa

SEQ ID NO: 38075 - DNA, 21 bp, Homo sapiens
gaggggggcactgcgcaagca

SEQ ID NO: 38076 - DNA, 19 bp, Homo sapiens
aggggggcactgcgcaagc

SEQ ID NO: 38077 - DNA, 19 bp, Homo sapiens
gaggggggcactgcgcaag

SEQ ID NO: 38078 - DNA, 20 bp, Homo sapiens
ggaggggggcactgcgcaag

SEQ ID NO: 38079 - DNA, 18 bp, Homo sapiens
gaggggggcactgcgcaa

SEQ ID NO: 38080 - DNA, 21 bp, Homo sapiens
cggcgacccctcactcaccgc

SEQ ID NO: 38081 - DNA, 22 bp, Homo sapiens
tcggcgacccctcactcaccgc

SEQ ID NO: 38082 - DNA, 21 bp, Homo sapiens
tcggcgacccctcactcaccg

SEQ ID NO: 38083 - DNA, 22 bp, Homo sapiens
ctcggcgacccctcactcaccg

SEQ ID NO: 38084 - DNA, 20 bp, Homo sapiens
tcggcgacccctcactcacc

SEQ ID NO: 38085 - DNA, 19 bp, Homo sapiens
tcggcgacccctcactcac

SEQ ID NO: 38086 - DNA, 17 bp, Homo sapiens
tcggcgacccctcactc

SEQ ID NO: 38087 - DNA, 19 bp, Homo sapiens
cggcgacctcggcgacccc

SEQ ID NO: 38088 - DNA, 18 bp, Homo sapiens
cggcgacctcggcgaccc

SEQ ID NO: 38089 - DNA, 16 bp, Homo sapiens
atttggcggggttcgg

SEQ ID NO: 38090 - DNA, 21 bp, Homo sapiens
tgagtgtggatttggcggggt

SEQ ID NO: 38091 - DNA, 22 bp, Homo sapiens
gtgagtgtggatttggcggggt

SEQ ID NO: 38092 - DNA, 21 bp, Homo sapiens
gtgagtgtggatttggcgggg

SEQ ID NO: 38093 - DNA, 20 bp, Homo sapiens
gtgagtgtggatttggcggg

SEQ ID NO: 38094 - DNA, 19 bp, Homo sapiens
gtgagtgtggatttggcgg

SEQ ID NO: 38095 - DNA, 25 bp, Homo sapiens
cagcccggatcccagcccacttacc

SEQ ID NO: 38096 - DNA, 26 bp, Homo sapiens
acagcccggatcccagcccacttacc

SEQ ID NO: 38097 - DNA, 24 bp, Homo sapiens
cagcccggatcccagcccacttac

SEQ ID NO: 38098 - DNA, 22 bp, Homo sapiens
agcccggatcccagcccactta

SEQ ID NO: 38099 - DNA, 23 bp, Homo sapiens
cagcccggatcccagcccactta

SEQ ID NO: 38100 - DNA, 23 bp, Homo sapiens
acagcccggatcccagcccactt

SEQ ID NO: 38101 - DNA, 21 bp, Homo sapiens
cagcccggatcccagcccact

SEQ ID NO: 38102 - DNA, 22 bp, Homo sapiens
acagcccggatcccagcccact

SEQ ID NO: 38103 - DNA, 20 bp, Homo sapiens
cagcccggatcccagcccac

SEQ ID NO: 38104 - DNA, 19 bp, Homo sapiens
cagcccggatcccagccca

SEQ ID NO: 38105 - DNA, 18 bp, Homo sapiens
cagcccggatcccagccc

SEQ ID NO: 38106 - DNA, 22 bp, Homo sapiens
gtgggttggggcgggctctggg

SEQ ID NO: 38107 - DNA, 21 bp, Homo sapiens
gtgggttggggcgggctctgg

SEQ ID NO: 38108 - DNA, 21 bp, Homo sapiens
ggtgggttggggcgggctctg

SEQ ID NO: 38109 - DNA, 19 bp, Homo sapiens
gtgggttggggcgggctct

SEQ ID NO: 38110 - DNA, 24 bp, Homo sapiens
tgcctccttggtctccggcagggg

SEQ ID NO: 38111 - DNA, 22 bp, Homo sapiens
gcctccttggtctccggcaggg

SEQ ID NO: 38112 - DNA, 23 bp, Homo sapiens
tgcctccttggtctccggcaggg

SEQ ID NO: 38113 - DNA, 22 bp, Homo sapiens
tgcctccttggtctccggcagg

SEQ ID NO: 38114 - DNA, 20 bp, Homo sapiens
tgcctccttggtctccggca

SEQ ID NO: 38115 - DNA, 19 bp, Homo sapiens
tgcctccttggtctccggc

SEQ ID NO: 38116 - DNA, 23 bp, Homo sapiens
ccctggggctgggcaggcggaaa

SEQ ID NO: 38117 - DNA, 24 bp, Homo sapiens
cccctggggctgggcaggcggaaa

SEQ ID NO: 38118 - DNA, 22 bp, Homo sapiens
ccctggggctgggcaggcggaa

SEQ ID NO: 38119 - DNA, 23 bp, Homo sapiens
cccctggggctgggcaggcggaa

SEQ ID NO: 38120 - DNA, 24 bp, Homo sapiens
acccctggggctgggcaggcggaa

SEQ ID NO: 38121 - DNA, 21 bp, Homo sapiens
ccctggggctgggcaggcgga

SEQ ID NO: 38122 - DNA, 23 bp, Homo sapiens
acccctggggctgggcaggcgga

SEQ ID NO: 38123 - DNA, 21 bp, Homo sapiens
gccagacccctggggctgggc

SEQ ID NO: 38124 - DNA, 20 bp, Homo sapiens
gccagacccctggggctggg

SEQ ID NO: 38125 - DNA, 17 bp, Homo sapiens
gccagacccctggggct

SEQ ID NO: 38126 - DNA, 16 bp, Homo sapiens
gccagacccctggggc

SEQ ID NO: 38127 - DNA, 18 bp, Homo sapiens
caggtaagcaggggctct

SEQ ID NO: 38128 - DNA, 17 bp, Homo sapiens
taagcaggggctctggg

SEQ ID NO: 38129 - DNA, 22 bp, Homo sapiens
taagcaggggctctgggtgatg

SEQ ID NO: 38130 - DNA, 23 bp, Homo sapiens
taagcaggggctctgggtgatgt

SEQ ID NO: 38131 - DNA, 25 bp, Homo sapiens
taagcaggggctctgggtgatgtga

SEQ ID NO: 38132 - DNA, 26 bp, Homo sapiens
taagcaggggctctgggtgatgtgag

SEQ ID NO: 38133 - DNA, 20 bp, Homo sapiens
caccctcctccacagcccct

SEQ ID NO: 38134 - DNA, 26 bp, Homo sapiens
ccctcctccacagcccctgctcattc

SEQ ID NO: 38135 - DNA, 20 bp, Homo sapiens
ctcctccacagcccctgctc

SEQ ID NO: 38136 - DNA, 23 bp, Homo sapiens
ctcctccacagcccctgctcatt

SEQ ID NO: 38137 - DNA, 24 bp, Homo sapiens
ctcctccacagcccctgctcattc

SEQ ID NO: 38138 - DNA, 21 bp, Homo sapiens
tcctccacagcccctgctcat

SEQ ID NO: 38139 - DNA, 22 bp, Homo sapiens
tcctccacagcccctgctcatt

SEQ ID NO: 38140 - DNA, 18 bp, Homo sapiens
agctggtgagtggggctc

SEQ ID NO: 38141 - DNA, 20 bp, Homo sapiens
gtgagtggggctcccgggac

SEQ ID NO: 38142 - DNA, 21 bp, Homo sapiens
gtgagtggggctcccgggacg

SEQ ID NO: 38143 - DNA, 22 bp, Homo sapiens
gtgagtggggctcccgggacgg

SEQ ID NO: 38144 - DNA, 23 bp, Homo sapiens
gtgagtggggctcccgggacggc

SEQ ID NO: 38145 - DNA, 25 bp, Homo sapiens
gtgagtggggctcccgggacggcgc

SEQ ID NO: 38146 - DNA, 26 bp, Homo sapiens
gtgagtggggctcccgggacggcgcc

SEQ ID NO: 38147 - DNA, 19 bp, Homo sapiens
tgagtggggctcccgggac

SEQ ID NO: 38148 - DNA, 20 bp, Homo sapiens
tgagtggggctcccgggacg

SEQ ID NO: 38149 - DNA, 21 bp, Homo sapiens
tgagtggggctcccgggacgg

SEQ ID NO: 38150 - DNA, 22 bp, Homo sapiens
tgagtggggctcccgggacggc

SEQ ID NO: 38151 - DNA, 24 bp, Homo sapiens
tgagtggggctcccgggacggcgc

SEQ ID NO: 38152 - DNA, 25 bp, Homo sapiens
tgagtggggctcccgggacggcgcc

SEQ ID NO: 38153 - DNA, 26 bp, Homo sapiens
tgagtggggctcccgggacggcgccc

SEQ ID NO: 38154 - DNA, 24 bp, Homo sapiens
tggggctcccgggacggcgcccgc

SEQ ID NO: 38155 - DNA, 19 bp, Homo sapiens
tcccgggacggcgcccgcc

SEQ ID NO: 38156 - DNA, 20 bp, Homo sapiens
cctggcccggcgacgtctca

SEQ ID NO: 38157 - DNA, 21 bp, Homo sapiens
cctggcccggcgacgtctcac

SEQ ID NO: 38158 - DNA, 22 bp, Homo sapiens
cctggcccggcgacgtctcacg

SEQ ID NO: 38159 - DNA, 23 bp, Homo sapiens
cctggcccggcgacgtctcacgg

SEQ ID NO: 38160 - DNA, 24 bp, Homo sapiens
cctggcccggcgacgtctcacggt

SEQ ID NO: 38161 - DNA, 25 bp, Homo sapiens
cctggcccggcgacgtctcacggtc

SEQ ID NO: 38162 - DNA, 24 bp, Homo sapiens
ctggcccggcgacgtctcacggtc

SEQ ID NO: 38163 - DNA, 22 bp, Homo sapiens
tggcccggcgacgtctcacggt

SEQ ID NO: 38164 - DNA, 24 bp, Homo sapiens
tggcccggcgacgtctcacggtcc

SEQ ID NO: 38165 - DNA, 23 bp, Homo sapiens
ggcccggcgacgtctcacggtcc

SEQ ID NO: 38166 - DNA, 16 bp, Homo sapiens
ggcgacgtctcacggt

SEQ ID NO: 38167 - DNA, 18 bp, Homo sapiens
cgacgtctcacggtccct

SEQ ID NO: 38168 - DNA, 20 bp, Homo sapiens
cgacgtctcacggtccctct

SEQ ID NO: 38169 - DNA, 21 bp, Homo sapiens
cgacgtctcacggtccctctc

SEQ ID NO: 38170 - DNA, 19 bp, Homo sapiens
gacgtctcacggtccctct

SEQ ID NO: 38171 - DNA, 20 bp, Homo sapiens
gacgtctcacggtccctctc

SEQ ID NO: 38172 - DNA, 18 bp, Homo sapiens
cgtctcacggtccctctc

SEQ ID NO: 38173 - DNA, 19 bp, Homo sapiens
cctgggcagcgtgtggctg

SEQ ID NO: 38174 - DNA, 20 bp, Homo sapiens
cctgggcagcgtgtggctga

SEQ ID NO: 38175 - DNA, 21 bp, Homo sapiens
cctgggcagcgtgtggctgaa

SEQ ID NO: 38176 - DNA, 22 bp, Homo sapiens
cctgggcagcgtgtggctgaag

SEQ ID NO: 38177 - DNA, 24 bp, Homo sapiens
cctgggcagcgtgtggctgaaggt

SEQ ID NO: 38178 - DNA, 25 bp, Homo sapiens
cctgggcagcgtgtggctgaaggtc

SEQ ID NO: 38179 - DNA, 26 bp, Homo sapiens
cctgggcagcgtgtggctgaaggtca

SEQ ID NO: 38180 - DNA, 28 bp, Homo sapiens
cctgggcagcgtgtggctgaaggtcacc

SEQ ID NO: 38181 - DNA, 22 bp, Homo sapiens
tgggcagcgtgtggctgaaggt

SEQ ID NO: 38182 - DNA, 23 bp, Homo sapiens
tgggcagcgtgtggctgaaggtc

SEQ ID NO: 38183 - DNA, 18 bp, Homo sapiens
ttggccatggggctgcgc

SEQ ID NO: 38184 - DNA, 19 bp, Homo sapiens
ttggccatggggctgcgcg

SEQ ID NO: 38185 - DNA, 21 bp, Homo sapiens
ttggccatggggctgcgcggg

SEQ ID NO: 38186 - DNA, 22 bp, Homo sapiens
ttggccatggggctgcgcgggg

SEQ ID NO: 38187 - DNA, 23 bp, Homo sapiens
ttggccatggggctgcgcggggc

SEQ ID NO: 38188 - DNA, 24 bp, Homo sapiens
ttggccatggggctgcgcggggcc

SEQ ID NO: 38189 - DNA, 25 bp, Homo sapiens
ttggccatggggctgcgcggggcca

SEQ ID NO: 38190 - DNA, 26 bp, Homo sapiens
ttggccatggggctgcgcggggccag

SEQ ID NO: 38191 - DNA, 23 bp, Homo sapiens
ctacctgacaatacagtatgtgt

SEQ ID NO: 38192 - DNA, 24 bp, Homo sapiens
actacctgacaatacagtatgtgt

SEQ ID NO: 38193 - DNA, 22 bp, Homo sapiens
ctacctgacaatacagtatgtg

SEQ ID NO: 38194 - DNA, 23 bp, Homo sapiens
actacctgacaatacagtatgtg

SEQ ID NO: 38195 - DNA, 22 bp, Homo sapiens
actacctgacaatacagtatgt

SEQ ID NO: 38196 - DNA, 21 bp, Homo sapiens
actacctgacaatacagtatg

SEQ ID NO: 38197 - DNA, 20 bp, Homo sapiens
actacctgacaatacagtat

SEQ ID NO: 38198 - DNA, 21 bp, Homo sapiens
cactacctgacaatacagtat

SEQ ID NO: 38199 - DNA, 22 bp, Homo sapiens
tcactacctgacaatacagtat

SEQ ID NO: 38200 - DNA, 21 bp, Homo sapiens
tcactacctgacaatacagta

SEQ ID NO: 38201 - DNA, 22 bp, Homo sapiens
atcactacctgacaatacagta

SEQ ID NO: 38202 - DNA, 20 bp, Homo sapiens
ttgtcaggtagtgataggat

SEQ ID NO: 38203 - DNA, 21 bp, Homo sapiens
attgtcaggtagtgataggat

SEQ ID NO: 38204 - DNA, 22 bp, Homo sapiens
tattgtcaggtagtgataggat

SEQ ID NO: 38205 - DNA, 24 bp, Homo sapiens
tgtattgtcaggtagtgataggat

SEQ ID NO: 38206 - DNA, 23 bp, Homo sapiens
tgtattgtcaggtagtgatagga

SEQ ID NO: 38207 - DNA, 20 bp, Homo sapiens
tattgtcaggtagtgatagg

SEQ ID NO: 38208 - DNA, 24 bp, Homo sapiens
tgctgtattgtcaggtagtgatag

SEQ ID NO: 38209 - DNA, 22 bp, Homo sapiens
gctgtattgtcaggtagtgata

SEQ ID NO: 38210 - DNA, 23 bp, Homo sapiens
tgctgtattgtcaggtagtgata

SEQ ID NO: 38211 - DNA, 24 bp, Homo sapiens
ctgctgtattgtcaggtagtgata

SEQ ID NO: 38212 - DNA, 25 bp, Homo sapiens
actgctgtattgtcaggtagtgata

SEQ ID NO: 38213 - DNA, 21 bp, Homo sapiens
gctgtattgtcaggtagtgat

SEQ ID NO: 38214 - DNA, 22 bp, Homo sapiens
tgctgtattgtcaggtagtgat

SEQ ID NO: 38215 - DNA, 20 bp, Homo sapiens
gctgtattgtcaggtagtga

SEQ ID NO: 38216 - DNA, 22 bp, Homo sapiens
ctgctgtattgtcaggtagtga

SEQ ID NO: 38217 - DNA, 20 bp, Homo sapiens
tgctgtattgtcaggtagtg

SEQ ID NO: 38218 - DNA, 21 bp, Homo sapiens
ctgctgtattgtcaggtagtg

SEQ ID NO: 38219 - DNA, 22 bp, Homo sapiens
actgctgtattgtcaggtagtg

SEQ ID NO: 38220 - DNA, 19 bp, Homo sapiens
tgctgtattgtcaggtagt

SEQ ID NO: 38221 - DNA, 21 bp, Homo sapiens
actgctgtattgtcaggtagt

SEQ ID NO: 38222 - DNA, 20 bp, Homo sapiens
cagcgctgtcttccctgcct

SEQ ID NO: 38223 - DNA, 25 bp, Homo sapiens
acgcctcttcagcgctgtcttccct

SEQ ID NO: 38224 - DNA, 23 bp, Homo sapiens
acgcctcttcagcgctgtcttcc

SEQ ID NO: 38225 - DNA, 22 bp, Homo sapiens
acgcctcttcagcgctgtcttc

SEQ ID NO: 38226 - DNA, 21 bp, Homo sapiens
acgcctcttcagcgctgtctt

SEQ ID NO: 38227 - DNA, 20 bp, Homo sapiens
acgcctcttcagcgctgtct

SEQ ID NO: 38228 - DNA, 20 bp, Homo sapiens
cagtgactgttcagacgtcc

SEQ ID NO: 38229 - DNA, 21 bp, Homo sapiens
gcagtgactgttcagacgtcc

SEQ ID NO: 38230 - DNA, 22 bp, Homo sapiens
ggcagtgactgttcagacgtcc

SEQ ID NO: 38231 - DNA, 20 bp, Homo sapiens
gcagtgactgttcagacgtc

SEQ ID NO: 38232 - DNA, 21 bp, Homo sapiens
ggcagtgactgttcagacgtc

SEQ ID NO: 38233 - DNA, 22 bp, Homo sapiens
caggcagtgactgttcagacgt

SEQ ID NO: 38234 - DNA, 21 bp, Homo sapiens
caggcagtgactgttcagacg

SEQ ID NO: 38235 - DNA, 27 bp, Homo sapiens
tattgcttaagaatacgcgtagtcgag

SEQ ID NO: 38236 - DNA, 28 bp, Homo sapiens
ttattgcttaagaatacgcgtagtcgag

SEQ ID NO: 38237 - DNA, 24 bp, Homo sapiens
tattgcttaagaatacgcgtagtc

SEQ ID NO: 38238 - DNA, 25 bp, Homo sapiens
ttattgcttaagaatacgcgtagtc

SEQ ID NO: 38239 - DNA, 20 bp, Homo sapiens
tgcttaagaatacgcgtagt

SEQ ID NO: 38240 - DNA, 22 bp, Homo sapiens
attgcttaagaatacgcgtagt

SEQ ID NO: 38241 - DNA, 23 bp, Homo sapiens
tattgcttaagaatacgcgtagt

SEQ ID NO: 38242 - DNA, 24 bp, Homo sapiens
ttattgcttaagaatacgcgtagt

SEQ ID NO: 38243 - DNA, 19 bp, Homo sapiens
tgcttaagaatacgcgtag

SEQ ID NO: 38244 - DNA, 21 bp, Homo sapiens
attgcttaagaatacgcgtag

SEQ ID NO: 38245 - DNA, 22 bp, Homo sapiens
tattgcttaagaatacgcgtag

SEQ ID NO: 38246 - DNA, 22 bp, Homo sapiens
ttattgcttaagaatacgcgta

SEQ ID NO: 38247 - DNA, 21 bp, Homo sapiens
ttattgcttaagaatacgcgt

SEQ ID NO: 38248 - DNA, 20 bp, Homo sapiens
ttattgcttaagaatacgcg

SEQ ID NO: 38249 - DNA, 18 bp, Homo sapiens
ttattgcttaagaatacg

SEQ ID NO: 38250 - DNA, 24 bp, Homo sapiens
ctcatccccatctcctttcagatg

SEQ ID NO: 38251 - DNA, 25 bp, Homo sapiens
gctcatccccatctcctttcagatg

SEQ ID NO: 38252 - DNA, 23 bp, Homo sapiens
ctcatccccatctcctttcagat

SEQ ID NO: 38253 - DNA, 24 bp, Homo sapiens
gctcatccccatctcctttcagat

SEQ ID NO: 38254 - DNA, 22 bp, Homo sapiens
ctcatccccatctcctttcaga

SEQ ID NO: 38255 - DNA, 23 bp, Homo sapiens
gctcatccccatctcctttcaga

SEQ ID NO: 38256 - DNA, 22 bp, Homo sapiens
tgctcatccccatctcctttca

SEQ ID NO: 38257 - DNA, 24 bp, Homo sapiens
tgggggagatgggggttgaacttc

SEQ ID NO: 38258 - DNA, 23 bp, Homo sapiens
tgggggagatgggggttgaactt

SEQ ID NO: 38259 - DNA, 22 bp, Homo sapiens
tgggggagatgggggttgaact

SEQ ID NO: 38260 - DNA, 27 bp, Homo sapiens
ccaaggtgggggagatgggggttgaac

SEQ ID NO: 38261 - DNA, 20 bp, Homo sapiens
aggtgggggagatgggggtt

SEQ ID NO: 38262 - DNA, 17 bp, Homo sapiens
atcggctcagcatgccc

SEQ ID NO: 38263 - DNA, 24 bp, Homo sapiens
cgccgcgcgcatcggctcagcatg

SEQ ID NO: 38264 - DNA, 22 bp, Homo sapiens
cgccgcgcgcatcggctcagca

SEQ ID NO: 38265 - DNA, 22 bp, Homo sapiens
ccgccgcgcgcatcggctcagc

SEQ ID NO: 38266 - DNA, 17 bp, Homo sapiens
ctctgccgccgcgcgca

SEQ ID NO: 38267 - DNA, 16 bp, Homo sapiens
ctctgccgccgcgcgc

SEQ ID NO: 38268 - DNA, 21 bp, Homo sapiens
gtggcgcgcggcggctcggag

SEQ ID NO: 38269 - DNA, 25 bp, Homo sapiens
gtgagtagtggcgcgcggcggctcg

SEQ ID NO: 38270 - DNA, 24 bp, Homo sapiens
gtgagtagtggcgcgcggcggctc

SEQ ID NO: 38271 - DNA, 23 bp, Homo sapiens
gtgagtagtggcgcgcggcggct

SEQ ID NO: 38272 - DNA, 21 bp, Homo sapiens
gtgagtagtggcgcgcggcgg

SEQ ID NO: 38273 - DNA, 20 bp, Homo sapiens
gtgagtagtggcgcgcggcg

SEQ ID NO: 38274 - DNA, 18 bp, Homo sapiens
gtgagtagtggcgcgcgg

SEQ ID NO: 38275 - DNA, 16 bp, Homo sapiens
gtgagtagtggcgcgc

SEQ ID NO: 38276 - DNA, 19 bp, Homo sapiens
gagacggtgagtagtggcg

SEQ ID NO: 38277 - DNA, 22 bp, Homo sapiens
ttctgggaggttgtagcagtgg

SEQ ID NO: 38278 - DNA, 17 bp, Homo sapiens
tctgggaggttgtagca

SEQ ID NO: 38279 - DNA, 19 bp, Homo sapiens
tctgggaggttgtagcagt

SEQ ID NO: 38280 - DNA, 20 bp, Homo sapiens
tctgggaggttgtagcagtg

SEQ ID NO: 38281 - DNA, 21 bp, Homo sapiens
tctgggaggttgtagcagtgg

SEQ ID NO: 38282 - DNA, 22 bp, Homo sapiens
tctgggaggttgtagcagtgga

SEQ ID NO: 38283 - DNA, 24 bp, Homo sapiens
tctgggaggttgtagcagtggaaa

SEQ ID NO: 38284 - DNA, 25 bp, Homo sapiens
tctgggaggttgtagcagtggaaaa

SEQ ID NO: 38285 - DNA, 23 bp, Homo sapiens
ttcctctgatcgccctctcagct

SEQ ID NO: 38286 - DNA, 20 bp, Homo sapiens
tcctctgatcgccctctcag

SEQ ID NO: 38287 - DNA, 21 bp, Homo sapiens
tcctctgatcgccctctcagc

SEQ ID NO: 38288 - DNA, 22 bp, Homo sapiens
tcctctgatcgccctctcagct

SEQ ID NO: 38289 - DNA, 25 bp, Homo sapiens
tcctctgatcgccctctcagctctt

SEQ ID NO: 38290 - DNA, 21 bp, Homo sapiens
cctctgatcgccctctcagct

SEQ ID NO: 38291 - DNA, 22 bp, Homo sapiens
cctctgatcgccctctcagctc

SEQ ID NO: 38292 - DNA, 23 bp, Homo sapiens
cctctgatcgccctctcagctct

SEQ ID NO: 38293 - DNA, 24 bp, Homo sapiens
cctctgatcgccctctcagctctt

SEQ ID NO: 38294 - DNA, 20 bp, Homo sapiens
ctctgatcgccctctcagct

SEQ ID NO: 38295 - DNA, 19 bp, Homo sapiens
tctgatcgccctctcagct

SEQ ID NO: 38296 - DNA, 21 bp, Homo sapiens
tctgatcgccctctcagctct

SEQ ID NO: 38297 - DNA, 22 bp, Homo sapiens
tctgatcgccctctcagctctt

SEQ ID NO: 38298 - DNA, 16 bp, Homo sapiens
gcgggaccgccctcgt

SEQ ID NO: 38299 - DNA, 18 bp, Homo sapiens
ccgcgggaccgccctcgt

SEQ ID NO: 38300 - DNA, 19 bp, Homo sapiens
gccgcgggaccgccctcgt

SEQ ID NO: 38301 - DNA, 20 bp, Homo sapiens
cgccgcgggaccgccctcgt

SEQ ID NO: 38302 - DNA, 21 bp, Homo sapiens
gcgccgcgggaccgccctcgt

SEQ ID NO: 38303 - DNA, 22 bp, Homo sapiens
ggcgccgcgggaccgccctcgt

SEQ ID NO: 38304 - DNA, 23 bp, Homo sapiens
gggcgccgcgggaccgccctcgt

SEQ ID NO: 38305 - DNA, 25 bp, Homo sapiens
cggggcgccgcgggaccgccctcgt

SEQ ID NO: 38306 - DNA, 16 bp, Homo sapiens
cgcgggaccgccctcg

SEQ ID NO: 38307 - DNA, 17 bp, Homo sapiens
ccgcgggaccgccctcg

SEQ ID NO: 38308 - DNA, 18 bp, Homo sapiens
gccgcgggaccgccctcg

SEQ ID NO: 38309 - DNA, 19 bp, Homo sapiens
cgccgcgggaccgccctcg

SEQ ID NO: 38310 - DNA, 22 bp, Homo sapiens
gggcgccgcgggaccgccctcg

SEQ ID NO: 38311 - DNA, 26 bp, Homo sapiens
ggcggggcgccgcgggaccgccctcg

SEQ ID NO: 38312 - DNA, 19 bp, Homo sapiens
gcgccgcgggaccgccctc

SEQ ID NO: 38313 - DNA, 24 bp, Homo sapiens
gcggggcgccgcgggaccgccctc

SEQ ID NO: 38314 - DNA, 19 bp, Homo sapiens
ggcgccgcgggaccgccct

SEQ ID NO: 38315 - DNA, 22 bp, Homo sapiens
cggggcgccgcgggaccgccct

SEQ ID NO: 38316 - DNA, 19 bp, Homo sapiens
gggcgccgcgggaccgccc

SEQ ID NO: 38317 - DNA, 20 bp, Homo sapiens
ggggcgccgcgggaccgccc

SEQ ID NO: 38318 - DNA, 27 bp, Homo sapiens
cccaggcggggcgccgcgggaccgccc

SEQ ID NO: 38319 - DNA, 17 bp, Homo sapiens
ggcgccgcgggaccgcc

SEQ ID NO: 38320 - DNA, 17 bp, Homo sapiens
gggcgccgcgggaccgc

SEQ ID NO: 38321 - DNA, 21 bp, Homo sapiens
ggcggggcgccgcgggaccgc

SEQ ID NO: 38322 - DNA, 16 bp, Homo sapiens
gggcgccgcgggaccg

SEQ ID NO: 38323 - DNA, 20 bp, Homo sapiens
ggcggggcgccgcgggaccg

SEQ ID NO: 38324 - DNA, 22 bp, Homo sapiens
ccaggcggggcgccgcgggacc

SEQ ID NO: 38325 - DNA, 25 bp, Homo sapiens
gtcccaggcggggcgccgcgggacc

SEQ ID NO: 38326 - DNA, 26 bp, Homo sapiens
cgtcccaggcggggcgccgcgggacc

SEQ ID NO: 38327 - DNA, 22 bp, Homo sapiens
cccaggcggggcgccgcgggac

SEQ ID NO: 38328 - DNA, 23 bp, Homo sapiens
gtcccaggcggggcgccgcggga

SEQ ID NO: 38329 - DNA, 24 bp, Homo sapiens
cgtcccaggcggggcgccgcggga

SEQ ID NO: 38330 - DNA, 19 bp, Homo sapiens
cccaggcggggcgccgcgg

SEQ ID NO: 38331 - DNA, 20 bp, Homo sapiens
tcccaggcggggcgccgcgg

SEQ ID NO: 38332 - DNA, 18 bp, Homo sapiens
cccaggcggggcgccgcg

SEQ ID NO: 38333 - DNA, 20 bp, Homo sapiens
gtcccaggcggggcgccgcg

SEQ ID NO: 38334 - DNA, 21 bp, Homo sapiens
cgtcccaggcggggcgccgcg

SEQ ID NO: 38335 - DNA, 20 bp, Homo sapiens
cgtcccaggcggggcgccgc

SEQ ID NO: 38336 - DNA, 16 bp, Homo sapiens
cgtcccaggcggggcg

SEQ ID NO: 38337 - DNA, 16 bp, Homo sapiens
tgggaacgggttccgg

SEQ ID NO: 38338 - DNA, 17 bp, Homo sapiens
tgggaacgggttccggc

SEQ ID NO: 38339 - DNA, 18 bp, Homo sapiens
tgggaacgggttccggca

SEQ ID NO: 38340 - DNA, 19 bp, Homo sapiens
tgggaacgggttccggcag

SEQ ID NO: 38341 - DNA, 20 bp, Homo sapiens
tgggaacgggttccggcaga

SEQ ID NO: 38342 - DNA, 21 bp, Homo sapiens
tgggaacgggttccggcagac

SEQ ID NO: 38343 - DNA, 22 bp, Homo sapiens
tgggaacgggttccggcagacg

SEQ ID NO: 38344 - DNA, 23 bp, Homo sapiens
tgggaacgggttccggcagacgc

SEQ ID NO: 38345 - DNA, 24 bp, Homo sapiens
tgggaacgggttccggcagacgct

SEQ ID NO: 38346 - DNA, 26 bp, Homo sapiens
tgggaacgggttccggcagacgctga

SEQ ID NO: 38347 - DNA, 27 bp, Homo sapiens
tgggaacgggttccggcagacgctgag

SEQ ID NO: 38348 - DNA, 18 bp, Homo sapiens
gggaacgggttccggcag

SEQ ID NO: 38349 - DNA, 19 bp, Homo sapiens
gggaacgggttccggcaga

SEQ ID NO: 38350 - DNA, 20 bp, Homo sapiens
gggaacgggttccggcagac

SEQ ID NO: 38351 - DNA, 21 bp, Homo sapiens
gggaacgggttccggcagacg

SEQ ID NO: 38352 - DNA, 23 bp, Homo sapiens
gggaacgggttccggcagacgct

SEQ ID NO: 38353 - DNA, 24 bp, Homo sapiens
gggaacgggttccggcagacgctg

SEQ ID NO: 38354 - DNA, 25 bp, Homo sapiens
gggaacgggttccggcagacgctga

SEQ ID NO: 38355 - DNA, 19 bp, Homo sapiens
ggaacgggttccggcagac

SEQ ID NO: 38356 - DNA, 23 bp, Homo sapiens
gaacgggttccggcagacgctga

SEQ ID NO: 38357 - DNA, 24 bp, Homo sapiens
aacgggttccggcagacgctgagg

SEQ ID NO: 38358 - DNA, 16 bp, Homo sapiens
tcgcgccccggctccc

SEQ ID NO: 38359 - DNA, 19 bp, Homo sapiens
tcgcgccccggctcccgtt

SEQ ID NO: 38360 - DNA, 21 bp, Homo sapiens
tcgcgccccggctcccgttcc

SEQ ID NO: 38361 - DNA, 20 bp, Homo sapiens
cgcgccccggctcccgttcc

SEQ ID NO: 38362 - DNA, 21 bp, Homo sapiens
cgcgccccggctcccgttcca

SEQ ID NO: 38363 - DNA, 22 bp, Homo sapiens
cgcgccccggctcccgttccag

SEQ ID NO: 38364 - DNA, 24 bp, Homo sapiens
cgcgccccggctcccgttccaggt

SEQ ID NO: 38365 - DNA, 21 bp, Homo sapiens
gcgccccggctcccgttccag

SEQ ID NO: 38366 - DNA, 22 bp, Homo sapiens
gcgccccggctcccgttccagg

SEQ ID NO: 38367 - DNA, 23 bp, Homo sapiens
gcgccccggctcccgttccaggt

SEQ ID NO: 38368 - DNA, 21 bp, Homo sapiens
cgccccggctcccgttccagg

SEQ ID NO: 38369 - DNA, 21 bp, Homo sapiens
gccccggctcccgttccaggt

SEQ ID NO: 38370 - DNA, 22 bp, Homo sapiens
gccccggctcccgttccaggtg

SEQ ID NO: 38371 - DNA, 20 bp, Homo sapiens
ccccggctcccgttccaggt

SEQ ID NO: 38372 - DNA, 21 bp, Homo sapiens
ccccggctcccgttccaggtg

SEQ ID NO: 38373 - DNA, 21 bp, Homo sapiens
ggggctcctgcgtaggatctg

SEQ ID NO: 38374 - DNA, 17 bp, Homo sapiens
gggctcctgcgtaggat

SEQ ID NO: 38375 - DNA, 19 bp, Homo sapiens
gggctcctgcgtaggatct

SEQ ID NO: 38376 - DNA, 28 bp, Homo sapiens
gggctcctgcgtaggatctgaggagtgg

SEQ ID NO: 38377 - DNA, 23 bp, Homo sapiens
ggctcctgcgtaggatctgagga

SEQ ID NO: 38378 - DNA, 19 bp, Homo sapiens
gctcctgcgtaggatctga

SEQ ID NO: 38379 - DNA, 21 bp, Homo sapiens
gctcctgcgtaggatctgagg

SEQ ID NO: 38380 - DNA, 21 bp, Homo sapiens
ctcctgcgtaggatctgagga

SEQ ID NO: 38381 - DNA, 22 bp, Homo sapiens
ctcctgcgtaggatctgaggag

SEQ ID NO: 38382 - DNA, 23 bp, Homo sapiens
ctcctgcgtaggatctgaggagt

SEQ ID NO: 38383 - DNA, 21 bp, Homo sapiens
tcctgcgtaggatctgaggag

SEQ ID NO: 38384 - DNA, 23 bp, Homo sapiens
tcctgcgtaggatctgaggagtg

SEQ ID NO: 38385 - DNA, 19 bp, Homo sapiens
tgcgtaggatctgaggagt

SEQ ID NO: 38386 - DNA, 18 bp, Homo sapiens
gcgtaggatctgaggagt

SEQ ID NO: 38387 - DNA, 16 bp, Homo sapiens
taggactccagtgccc

SEQ ID NO: 38388 - DNA, 17 bp, Homo sapiens
taggactccagtgccct

SEQ ID NO: 38389 - DNA, 19 bp, Homo sapiens
taggactccagtgccctcc

SEQ ID NO: 38390 - DNA, 21 bp, Homo sapiens
taggactccagtgccctcctc

SEQ ID NO: 38391 - DNA, 25 bp, Homo sapiens
taggactccagtgccctcctctccc

SEQ ID NO: 38392 - DNA, 26 bp, Homo sapiens
taggactccagtgccctcctctccca

SEQ ID NO: 38393 - DNA, 25 bp, Homo sapiens
actccagtgccctcctctcccaaga

SEQ ID NO: 38394 - DNA, 22 bp, Homo sapiens
ctccagtgccctcctctcccaa

SEQ ID NO: 38395 - DNA, 23 bp, Homo sapiens
ccagtgccctcctctcccaagag

SEQ ID NO: 38396 - DNA, 18 bp, Homo sapiens
gccctcctctcccaagag

SEQ ID NO: 38397 - DNA, 18 bp, Homo sapiens
ttcagctttcccttcaga

SEQ ID NO: 38398 - DNA, 19 bp, Homo sapiens
ttcagctttcccttcagag

SEQ ID NO: 38399 - DNA, 21 bp, Homo sapiens
tcagctttcccttcagagcct

SEQ ID NO: 38400 - DNA, 23 bp, Homo sapiens
tttcccttcagagcctggctttg

SEQ ID NO: 38401 - DNA, 24 bp, Homo sapiens
tttcccttcagagcctggctttgg

SEQ ID NO: 38402 - DNA, 22 bp, Homo sapiens
ttcagagcctggctttggcatc

SEQ ID NO: 38403 - DNA, 21 bp, Homo sapiens
atgaaagccaggctctgaagg

SEQ ID NO: 38404 - DNA, 23 bp, Homo sapiens
agccaggctctgaagggaaagtt

SEQ ID NO: 38405 - DNA, 24 bp, Homo sapiens
agccaggctctgaagggaaagttg

SEQ ID NO: 38406 - DNA, 21 bp, Homo sapiens
gccaggctctgaagggaaagt

SEQ ID NO: 38407 - DNA, 22 bp, Homo sapiens
gccaggctctgaagggaaagtt

SEQ ID NO: 38408 - DNA, 20 bp, Homo sapiens
ccaggctctgaagggaaagt

SEQ ID NO: 38409 - DNA, 21 bp, Homo sapiens
ccaggctctgaagggaaagtt

SEQ ID NO: 38410 - DNA, 23 bp, Homo sapiens
ccaggctctgaagggaaagttga

SEQ ID NO: 38411 - DNA, 22 bp, Homo sapiens
caggctctgaagggaaagttga

SEQ ID NO: 38412 - DNA, 21 bp, Homo sapiens
ctctgaagggaaagttgaatc

SEQ ID NO: 38413 - DNA, 22 bp, Homo sapiens
tatagtgtggctttcttagagc

SEQ ID NO: 38414 - DNA, 25 bp, Homo sapiens
aacatcactgcaagtcttaacagcc

SEQ ID NO: 38415 - DNA, 24 bp, Homo sapiens
aacatcactgcaagtcttaacagc

SEQ ID NO: 38416 - DNA, 21 bp, Homo sapiens
aacatcactgcaagtcttaac

SEQ ID NO: 38417 - DNA, 22 bp, Homo sapiens
aaacatcactgcaagtcttaac

SEQ ID NO: 38418 - DNA, 17 bp, Homo sapiens
ttaagacttgcagtgat

SEQ ID NO: 38419 - DNA, 18 bp, Homo sapiens
ttaagacttgcagtgatg

SEQ ID NO: 38420 - DNA, 19 bp, Homo sapiens
ttaagacttgcagtgatgt

SEQ ID NO: 38421 - DNA, 20 bp, Homo sapiens
ttaagacttgcagtgatgtt

SEQ ID NO: 38422 - DNA, 22 bp, Homo sapiens
ttaagacttgcagtgatgttta

SEQ ID NO: 38423 - DNA, 23 bp, Homo sapiens
ttaagacttgcagtgatgtttaa

SEQ ID NO: 38424 - DNA, 24 bp, Homo sapiens
ttaagacttgcagtgatgtttaac

SEQ ID NO: 38425 - DNA, 26 bp, Homo sapiens
ttaagacttgcagtgatgtttaactc

SEQ ID NO: 38426 - DNA, 27 bp, Homo sapiens
ttaagacttgcagtgatgtttaactcc

SEQ ID NO: 38427 - DNA, 20 bp, Homo sapiens
aaacatcactgcaagtctta

SEQ ID NO: 38428 - DNA, 20 bp, Homo sapiens
taagacttgcagtgatgttt

SEQ ID NO: 38429 - DNA, 19 bp, Homo sapiens
aaacatcactgcaagtctt

SEQ ID NO: 38430 - DNA, 26 bp, Homo sapiens
cagacttgctgtgatgttcacgtgga

SEQ ID NO: 38431 - DNA, 25 bp, Homo sapiens
acagacttgctgtgatgttcacgtg

SEQ ID NO: 38432 - DNA, 19 bp, Homo sapiens
acttgctgtgatgttcacg

SEQ ID NO: 38433 - DNA, 23 bp, Homo sapiens
acagacttgctgtgatgttcacg

SEQ ID NO: 38434 - DNA, 22 bp, Homo sapiens
acagacttgctgtgatgttcac

SEQ ID NO: 38435 - DNA, 19 bp, Homo sapiens
tgaacatcacagcaagtct

SEQ ID NO: 38436 - DNA, 21 bp, Homo sapiens
tgaacatcacagcaagtctgt

SEQ ID NO: 38437 - DNA, 22 bp, Homo sapiens
cacagacttgctgtgatgttca

SEQ ID NO: 38438 - DNA, 22 bp, Homo sapiens
tgaacatcacagcaagtctgtg

SEQ ID NO: 38439 - DNA, 18 bp, Homo sapiens
gaacatcacagcaagtct

SEQ ID NO: 38440 - DNA, 19 bp, Homo sapiens
cagacttgctgtgatgttc

SEQ ID NO: 38441 - DNA, 19 bp, Homo sapiens
gaacatcacagcaagtctg

SEQ ID NO: 38442 - DNA, 20 bp, Homo sapiens
acagacttgctgtgatgttc

SEQ ID NO: 38443 - DNA, 20 bp, Homo sapiens
gaacatcacagcaagtctgt

SEQ ID NO: 38444 - DNA, 21 bp, Homo sapiens
cacagacttgctgtgatgttc

SEQ ID NO: 38445 - DNA, 21 bp, Homo sapiens
gaacatcacagcaagtctgtg

SEQ ID NO: 38446 - DNA, 22 bp, Homo sapiens
gaacatcacagcaagtctgtgc

SEQ ID NO: 38447 - DNA, 23 bp, Homo sapiens
gaacatcacagcaagtctgtgct

SEQ ID NO: 38448 - DNA, 24 bp, Homo sapiens
gaacatcacagcaagtctgtgctg

SEQ ID NO: 38449 - DNA, 18 bp, Homo sapiens
aacatcacagcaagtctg

SEQ ID NO: 38450 - DNA, 19 bp, Homo sapiens
acagacttgctgtgatgtt

SEQ ID NO: 38451 - DNA, 19 bp, Homo sapiens
aacatcacagcaagtctgt

SEQ ID NO: 38452 - DNA, 20 bp, Homo sapiens
cacagacttgctgtgatgtt

SEQ ID NO: 38453 - DNA, 20 bp, Homo sapiens
aacatcacagcaagtctgtg

SEQ ID NO: 38454 - DNA, 21 bp, Homo sapiens
aacatcacagcaagtctgtgc

SEQ ID NO: 38455 - DNA, 23 bp, Homo sapiens
aacatcacagcaagtctgtgctg

SEQ ID NO: 38456 - DNA, 21 bp, Homo sapiens
aggaatctgcattttagaaag

SEQ ID NO: 38457 - DNA, 26 bp, Homo sapiens
tggagtccaggaatctgcattttaga

SEQ ID NO: 38458 - DNA, 24 bp, Homo sapiens
gggtggagtccaggaatctgcatt

SEQ ID NO: 38459 - DNA, 23 bp, Homo sapiens
gccaaaactgcagttacttttgc

SEQ ID NO: 38460 - DNA, 21 bp, Homo sapiens
ccaaaactgcagttacttttg

SEQ ID NO: 38461 - DNA, 18 bp, Homo sapiens
agcttctttacagtgctg

SEQ ID NO: 38462 - DNA, 20 bp, Homo sapiens
agcttctttacagtgctgcc

SEQ ID NO: 38463 - DNA, 21 bp, Homo sapiens
agcttctttacagtgctgcct

SEQ ID NO: 38464 - DNA, 22 bp, Homo sapiens
agcttctttacagtgctgcctt

SEQ ID NO: 38465 - DNA, 24 bp, Homo sapiens
agcttctttacagtgctgccttgt

SEQ ID NO: 38466 - DNA, 25 bp, Homo sapiens
agcttctttacagtgctgccttgta

SEQ ID NO: 38467 - DNA, 26 bp, Homo sapiens
agcttctttacagtgctgccttgtag

SEQ ID NO: 38468 - DNA, 27 bp, Homo sapiens
agcttctttacagtgctgccttgtagc

SEQ ID NO: 38469 - DNA, 28 bp, Homo sapiens
agcttctttacagtgctgccttgtagca

SEQ ID NO: 38470 - DNA, 23 bp, Homo sapiens
agccctgtacaatgctgcttgac

SEQ ID NO: 38471 - DNA, 18 bp, Homo sapiens
agcagcattgtacagggc

SEQ ID NO: 38472 - DNA, 20 bp, Homo sapiens
agcagcattgtacagggcta

SEQ ID NO: 38473 - DNA, 21 bp, Homo sapiens
agcagcattgtacagggctat

SEQ ID NO: 38474 - DNA, 22 bp, Homo sapiens
agcagcattgtacagggctatg

SEQ ID NO: 38475 - DNA, 25 bp, Homo sapiens
agcagcattgtacagggctatgaaa

SEQ ID NO: 38476 - DNA, 26 bp, Homo sapiens
agcagcattgtacagggctatgaaag

SEQ ID NO: 38477 - DNA, 27 bp, Homo sapiens
agcagcattgtacagggctatgaaaga

SEQ ID NO: 38478 - DNA, 23 bp, Homo sapiens
cagcattgtacagggctatgaaa

SEQ ID NO: 38479 - DNA, 21 bp, Homo sapiens
gcattgtacagggctatgaaa

SEQ ID NO: 38480 - DNA, 21 bp, Homo sapiens
tcctcatgggagttcggggtg

SEQ ID NO: 38481 - DNA, 21 bp, Homo sapiens
tcatgggagttcggggtggtt

SEQ ID NO: 38482 - DNA, 23 bp, Homo sapiens
tcatgggagttcggggtggttgc

SEQ ID NO: 38483 - DNA, 19 bp, Homo sapiens
catgggagttcggggtggt

SEQ ID NO: 38484 - DNA, 20 bp, Homo sapiens
catgggagttcggggtggtt

SEQ ID NO: 38485 - DNA, 21 bp, Homo sapiens
catgggagttcggggtggttg

SEQ ID NO: 38486 - DNA, 24 bp, Homo sapiens
catgggagttcggggtggttgctg

SEQ ID NO: 38487 - DNA, 25 bp, Homo sapiens
catgggagttcggggtggttgctgg

SEQ ID NO: 38488 - DNA, 21 bp, Homo sapiens
atgggagttcggggtggttgc

SEQ ID NO: 38489 - DNA, 17 bp, Homo sapiens
agttcggggtggttgct

SEQ ID NO: 38490 - DNA, 18 bp, Homo sapiens
cagcaccctgtggctccc

SEQ ID NO: 38491 - DNA, 20 bp, Homo sapiens
cagcaccctgtggctcccac

SEQ ID NO: 38492 - DNA, 21 bp, Homo sapiens
cagcaccctgtggctcccaca

SEQ ID NO: 38493 - DNA, 23 bp, Homo sapiens
cagcaccctgtggctcccacagg

SEQ ID NO: 38494 - DNA, 24 bp, Homo sapiens
cagcaccctgtggctcccacaggt

SEQ ID NO: 38495 - DNA, 25 bp, Homo sapiens
cagcaccctgtggctcccacaggtg

SEQ ID NO: 38496 - DNA, 20 bp, Homo sapiens
agcaccctgtggctcccaca

SEQ ID NO: 38497 - DNA, 21 bp, Homo sapiens
agcaccctgtggctcccacag

SEQ ID NO: 38498 - DNA, 22 bp, Homo sapiens
agcaccctgtggctcccacagg

SEQ ID NO: 38499 - DNA, 24 bp, Homo sapiens
agcaccctgtggctcccacaggtg

SEQ ID NO: 38500 - DNA, 21 bp, Homo sapiens
gttgtgaaaatgaaatgagcc

SEQ ID NO: 38501 - DNA, 23 bp, Homo sapiens
tgtgaaaatgaaatgagcccagc

SEQ ID NO: 38502 - DNA, 24 bp, Homo sapiens
aaaatgaaatgagcccagcccatt

SEQ ID NO: 38503 - DNA, 19 bp, Homo sapiens
atgaaatgagcccagccca

SEQ ID NO: 38504 - DNA, 22 bp, Homo sapiens
atggggtgagatggggaggagc

SEQ ID NO: 38505 - DNA, 23 bp, Homo sapiens
atggggtgagatggggaggagca

SEQ ID NO: 38506 - DNA, 24 bp, Homo sapiens
atggggtgagatggggaggagcag

SEQ ID NO: 38507 - DNA, 26 bp, Homo sapiens
atggggtgagatggggaggagcagcc

SEQ ID NO: 38508 - DNA, 27 bp, Homo sapiens
atggggtgagatggggaggagcagcca

SEQ ID NO: 38509 - DNA, 28 bp, Homo sapiens
atggggtgagatggggaggagcagccag

SEQ ID NO: 38510 - DNA, 20 bp, Homo sapiens
tggggtgagatggggaggag

SEQ ID NO: 38511 - DNA, 21 bp, Homo sapiens
tggggtgagatggggaggagc

SEQ ID NO: 38512 - DNA, 22 bp, Homo sapiens
tggggtgagatggggaggagca

SEQ ID NO: 38513 - DNA, 24 bp, Homo sapiens
tggggtgagatggggaggagcagc

SEQ ID NO: 38514 - DNA, 25 bp, Homo sapiens
tggggtgagatggggaggagcagcc

SEQ ID NO: 38515 - DNA, 20 bp, Homo sapiens
tcaccgctcttcccctgacc

SEQ ID NO: 38516 - DNA, 20 bp, Homo sapiens
ccgctcttcccctgacccca

SEQ ID NO: 38517 - DNA, 22 bp, Homo sapiens
ccgctcttcccctgaccccagg

SEQ ID NO: 38518 - DNA, 23 bp, Homo sapiens
ccgctcttcccctgaccccaggt

SEQ ID NO: 38519 - DNA, 24 bp, Homo sapiens
ccgctcttcccctgaccccaggtt

SEQ ID NO: 38520 - DNA, 21 bp, Homo sapiens
cgctcttcccctgaccccagg

SEQ ID NO: 38521 - DNA, 22 bp, Homo sapiens
cgctcttcccctgaccccaggt

SEQ ID NO: 38522 - DNA, 24 bp, Homo sapiens
catcagcaccctatgtcctttctc

SEQ ID NO: 38523 - DNA, 25 bp, Homo sapiens
tcatcagcaccctatgtcctttctc

SEQ ID NO: 38524 - DNA, 24 bp, Homo sapiens
tcatcagcaccctatgtcctttct

SEQ ID NO: 38525 - DNA, 22 bp, Homo sapiens
catcagcaccctatgtcctttc

SEQ ID NO: 38526 - DNA, 23 bp, Homo sapiens
tcatcagcaccctatgtcctttc

SEQ ID NO: 38527 - DNA, 22 bp, Homo sapiens
tcatcagcaccctatgtccttt

SEQ ID NO: 38528 - DNA, 21 bp, Homo sapiens
ctcatcagcaccctatgtcct

SEQ ID NO: 38529 - DNA, 28 bp, Homo sapiens
aaagacatagttgcaagatgggattaga

SEQ ID NO: 38530 - DNA, 22 bp, Homo sapiens
gacatagttgcaagatgggatt

SEQ ID NO: 38531 - DNA, 25 bp, Homo sapiens
aaagacatagttgcaagatgggatt

SEQ ID NO: 38532 - DNA, 22 bp, Homo sapiens
agacatagttgcaagatgggat

SEQ ID NO: 38533 - DNA, 24 bp, Homo sapiens
aaagacatagttgcaagatgggat

SEQ ID NO: 38534 - DNA, 23 bp, Homo sapiens
aaagacatagttgcaagatggga

SEQ ID NO: 38535 - DNA, 21 bp, Homo sapiens
aaagacatagttgcaagatgg

SEQ ID NO: 38536 - DNA, 20 bp, Homo sapiens
aaagacatagttgcaagatg

SEQ ID NO: 38537 - DNA, 19 bp, Homo sapiens
aaagacatagttgcaagat

SEQ ID NO: 38538 - DNA, 18 bp, Homo sapiens
aaagacatagttgcaaga

SEQ ID NO: 38539 - DNA, 18 bp, Homo sapiens
agcatcatgaagtgcact

SEQ ID NO: 38540 - DNA, 20 bp, Homo sapiens
agcatcatgaagtgcactca

SEQ ID NO: 38541 - DNA, 21 bp, Homo sapiens
agcatcatgaagtgcactcat

SEQ ID NO: 38542 - DNA, 22 bp, Homo sapiens
agcatcatgaagtgcactcatg

SEQ ID NO: 38543 - DNA, 23 bp, Homo sapiens
agcatcatgaagtgcactcatga

SEQ ID NO: 38544 - DNA, 25 bp, Homo sapiens
agcatcatgaagtgcactcatgata

SEQ ID NO: 38545 - DNA, 21 bp, Homo sapiens
tgaagtgcactcatgatatgt

SEQ ID NO: 38546 - DNA, 22 bp, Homo sapiens
tgaagtgcactcatgatatgtt

SEQ ID NO: 38547 - DNA, 25 bp, Homo sapiens
tgaagtgcactcatgatatgtttgc

SEQ ID NO: 38548 - DNA, 21 bp, Homo sapiens
gaagtgcactcatgatatgtt

SEQ ID NO: 38549 - DNA, 22 bp, Homo sapiens
gaagtgcactcatgatatgttt

SEQ ID NO: 38550 - DNA, 25 bp, Homo sapiens
aagtgcactcatgatatgtttgccc

SEQ ID NO: 38551 - DNA, 19 bp, Homo sapiens
acgagggcatttcatgatg

SEQ ID NO: 38552 - DNA, 21 bp, Homo sapiens
acgagggcatttcatgatgca

SEQ ID NO: 38553 - DNA, 22 bp, Homo sapiens
acgagggcatttcatgatgcag

SEQ ID NO: 38554 - DNA, 16 bp, Homo sapiens
cgagggcatttcatga

SEQ ID NO: 38555 - DNA, 17 bp, Homo sapiens
cgagggcatttcatgat

SEQ ID NO: 38556 - DNA, 18 bp, Homo sapiens
cgagggcatttcatgatg

SEQ ID NO: 38557 - DNA, 19 bp, Homo sapiens
cgagggcatttcatgatgc

SEQ ID NO: 38558 - DNA, 20 bp, Homo sapiens
cgagggcatttcatgatgca

SEQ ID NO: 38559 - DNA, 21 bp, Homo sapiens
cgagggcatttcatgatgcag

SEQ ID NO: 38560 - DNA, 22 bp, Homo sapiens
cgagggcatttcatgatgcagg

SEQ ID NO: 38561 - DNA, 24 bp, Homo sapiens
cgagggcatttcatgatgcaggcg

SEQ ID NO: 38562 - DNA, 25 bp, Homo sapiens
cgagggcatttcatgatgcaggcgg

SEQ ID NO: 38563 - DNA, 26 bp, Homo sapiens
cgagggcatttcatgatgcaggcggg

SEQ ID NO: 38564 - DNA, 16 bp, Homo sapiens
ccctgctctaggctgg

SEQ ID NO: 38565 - DNA, 22 bp, Homo sapiens
ctaggctggtactgctgatgct

SEQ ID NO: 38566 - DNA, 21 bp, Homo sapiens
taggctggtactgctgatgct

SEQ ID NO: 38567 - DNA, 25 bp, Homo sapiens
agctctgctgctcactggcagtgtc

SEQ ID NO: 38568 - DNA, 24 bp, Homo sapiens
agctctgctgctcactggcagtgt

SEQ ID NO: 38569 - DNA, 23 bp, Homo sapiens
agctctgctgctcactggcagtg

SEQ ID NO: 38570 - DNA, 21 bp, Homo sapiens
agctctgctgctcactggcag

SEQ ID NO: 38571 - DNA, 20 bp, Homo sapiens
agctctgctgctcactggca

SEQ ID NO: 38572 - DNA, 24 bp, Homo sapiens
ggccagccaccaggagggctgcgt

SEQ ID NO: 38573 - DNA, 23 bp, Homo sapiens
ggccagccaccaggagggctgcg

SEQ ID NO: 38574 - DNA, 22 bp, Homo sapiens
ggccagccaccaggagggctgc

SEQ ID NO: 38575 - DNA, 20 bp, Homo sapiens
ggccagccaccaggagggct

SEQ ID NO: 38576 - DNA, 19 bp, Homo sapiens
ggccagccaccaggagggc

SEQ ID NO: 38577 - DNA, 18 bp, Homo sapiens
ggccagccaccaggaggg

SEQ ID NO: 38578 - DNA, 23 bp, Homo sapiens
cagagatggttgccttcctatat

SEQ ID NO: 38579 - DNA, 24 bp, Homo sapiens
ccagagatggttgccttcctatat

SEQ ID NO: 38580 - DNA, 21 bp, Homo sapiens
agagatggttgccttcctata

SEQ ID NO: 38581 - DNA, 22 bp, Homo sapiens
cagagatggttgccttcctata

SEQ ID NO: 38582 - DNA, 23 bp, Homo sapiens
ccagagatggttgccttcctata

SEQ ID NO: 38583 - DNA, 20 bp, Homo sapiens
agagatggttgccttcctat

SEQ ID NO: 38584 - DNA, 21 bp, Homo sapiens
cagagatggttgccttcctat

SEQ ID NO: 38585 - DNA, 21 bp, Homo sapiens
ccagagatggttgccttccta

SEQ ID NO: 38586 - DNA, 20 bp, Homo sapiens
cagggaggcgctcactctct

SEQ ID NO: 38587 - DNA, 19 bp, Homo sapiens
cagggaggcgctcactctc

SEQ ID NO: 38588 - DNA, 18 bp, Homo sapiens
cagggaggcgctcactct

SEQ ID NO: 38589 - DNA, 21 bp, Homo sapiens
tgttgcacttgtctcagtgag

SEQ ID NO: 38590 - DNA, 20 bp, Homo sapiens
tgttgcacttgtctcagtga

SEQ ID NO: 38591 - DNA, 19 bp, Homo sapiens
tgttgcacttgtctcagtg

SEQ ID NO: 38592 - DNA, 18 bp, Homo sapiens
tgttgcacttgtctcagt

SEQ ID NO: 38593 - DNA, 19 bp, Homo sapiens
tacagaccccggggagccc

SEQ ID NO: 38594 - DNA, 20 bp, Homo sapiens
gaccccggggagcccggcgg

SEQ ID NO: 38595 - DNA, 18 bp, Homo sapiens
ccccggggagcccggcgg

SEQ ID NO: 38596 - DNA, 19 bp, Homo sapiens
ccccggggagcccggcggt

SEQ ID NO: 38597 - DNA, 20 bp, Homo sapiens
ccccggggagcccggcggtg

SEQ ID NO: 38598 - DNA, 21 bp, Homo sapiens
ccccggggagcccggcggtga

SEQ ID NO: 38599 - DNA, 17 bp, Homo sapiens
cccggggagcccggcgg

SEQ ID NO: 38600 - DNA, 18 bp, Homo sapiens
cccggggagcccggcggt

SEQ ID NO: 38601 - DNA, 19 bp, Homo sapiens
cccggggagcccggcggtg

SEQ ID NO: 38602 - DNA, 16 bp, Homo sapiens
ccggggagcccggcgg

SEQ ID NO: 38603 - DNA, 17 bp, Homo sapiens
ccggggagcccggcggt

SEQ ID NO: 38604 - DNA, 17 bp, Homo sapiens
cggggagcccggcggtg

SEQ ID NO: 38605 - DNA, 25 bp, Homo sapiens
agggttgggtggaggctctcctgaa

SEQ ID NO: 38606 - DNA, 22 bp, Homo sapiens
ggttgggtggaggctctcctga

SEQ ID NO: 38607 - DNA, 24 bp, Homo sapiens
agggttgggtggaggctctcctga

SEQ ID NO: 38608 - DNA, 21 bp, Homo sapiens
ggttgggtggaggctctcctg

SEQ ID NO: 38609 - DNA, 23 bp, Homo sapiens
agggttgggtggaggctctcctg

SEQ ID NO: 38610 - DNA, 24 bp, Homo sapiens
gagggttgggtggaggctctcctg

SEQ ID NO: 38611 - DNA, 22 bp, Homo sapiens
agggttgggtggaggctctcct

SEQ ID NO: 38612 - DNA, 23 bp, Homo sapiens
gagggttgggtggaggctctcct

SEQ ID NO: 38613 - DNA, 21 bp, Homo sapiens
agggttgggtggaggctctcc

SEQ ID NO: 38614 - DNA, 20 bp, Homo sapiens
agggttgggtggaggctctc

SEQ ID NO: 38615 - DNA, 21 bp, Homo sapiens
gagggttgggtggaggctctc

SEQ ID NO: 38616 - DNA, 19 bp, Homo sapiens
agggttgggtggaggctct

SEQ ID NO: 38617 - DNA, 20 bp, Homo sapiens
gagggttgggtggaggctct

SEQ ID NO: 38618 - DNA, 26 bp, Homo sapiens
agggccccccctcaatcctgttgtgc

SEQ ID NO: 38619 - DNA, 24 bp, Homo sapiens
agggccccccctcaatcctgttgt

SEQ ID NO: 38620 - DNA, 23 bp, Homo sapiens
agggccccccctcaatcctgttg

SEQ ID NO: 38621 - DNA, 24 bp, Homo sapiens
gagggccccccctcaatcctgttg

SEQ ID NO: 38622 - DNA, 22 bp, Homo sapiens
agggccccccctcaatcctgtt

SEQ ID NO: 38623 - DNA, 22 bp, Homo sapiens
gagggccccccctcaatcctgt

SEQ ID NO: 38624 - DNA, 20 bp, Homo sapiens
agggccccccctcaatcctg

SEQ ID NO: 38625 - DNA, 21 bp, Homo sapiens
gagggccccccctcaatcctg

SEQ ID NO: 38626 - DNA, 19 bp, Homo sapiens
agggccccccctcaatcct

SEQ ID NO: 38627 - DNA, 17 bp, Homo sapiens
agggccccccctcaatc

SEQ ID NO: 38628 - DNA, 18 bp, Homo sapiens
cagaagcagggaggttct

SEQ ID NO: 38629 - DNA, 18 bp, Homo sapiens
tggaaggaggttgccgga

SEQ ID NO: 38630 - DNA, 23 bp, Homo sapiens
tggaaggaggttgccggacgctg

SEQ ID NO: 38631 - DNA, 24 bp, Homo sapiens
tggaaggaggttgccggacgctgc

SEQ ID NO: 38632 - DNA, 25 bp, Homo sapiens
tggaaggaggttgccggacgctgct

SEQ ID NO: 38633 - DNA, 26 bp, Homo sapiens
tggaaggaggttgccggacgctgctg

SEQ ID NO: 38634 - DNA, 22 bp, Homo sapiens
aaaggtaattgtggtttctgcc

SEQ ID NO: 38635 - DNA, 23 bp, Homo sapiens
aaaggtaattgtggtttctgcca

SEQ ID NO: 38636 - DNA, 24 bp, Homo sapiens
aaaggtaattgtggtttctgccat

SEQ ID NO: 38637 - DNA, 25 bp, Homo sapiens
aaaggtaattgtggtttctgccatt

SEQ ID NO: 38638 - DNA, 21 bp, Homo sapiens
aaggtaattgtggtttctgcc

SEQ ID NO: 38639 - DNA, 16 bp, Homo sapiens
ggttctgacccccatg

SEQ ID NO: 38640 - DNA, 23 bp, Homo sapiens
gtgaatgatgggttctgaccccc

SEQ ID NO: 38641 - DNA, 22 bp, Homo sapiens
gtgaatgatgggttctgacccc

SEQ ID NO: 38642 - DNA, 23 bp, Homo sapiens
agtgaatgatgggttctgacccc

SEQ ID NO: 38643 - DNA, 21 bp, Homo sapiens
gtgaatgatgggttctgaccc

SEQ ID NO: 38644 - DNA, 22 bp, Homo sapiens
agtgaatgatgggttctgaccc

SEQ ID NO: 38645 - DNA, 20 bp, Homo sapiens
gtgaatgatgggttctgacc

SEQ ID NO: 38646 - DNA, 19 bp, Homo sapiens
gtgaatgatgggttctgac

SEQ ID NO: 38647 - DNA, 20 bp, Homo sapiens
gccgccgcgccgggcccggg

SEQ ID NO: 38648 - DNA, 21 bp, Homo sapiens
ccgccgcgccgggcccgggtt

SEQ ID NO: 38649 - DNA, 19 bp, Homo sapiens
cgccgcgccgggcccgggt

SEQ ID NO: 38650 - DNA, 20 bp, Homo sapiens
cgcgccgggcccgggttggc

SEQ ID NO: 38651 - DNA, 18 bp, Homo sapiens
gcgccgggcccgggttgg

SEQ ID NO: 38652 - DNA, 19 bp, Homo sapiens
gcgccgggcccgggttggc

SEQ ID NO: 38653 - DNA, 16 bp, Homo sapiens
gaccaccctcccccca

SEQ ID NO: 38654 - DNA, 20 bp, Homo sapiens
tgctgaccaccctcccccca

SEQ ID NO: 38655 - DNA, 17 bp, Homo sapiens
ctgaccaccctcccccc

SEQ ID NO: 38656 - DNA, 26 bp, Homo sapiens
tgccccacctgctgaccaccctcccc

SEQ ID NO: 38657 - DNA, 25 bp, Homo sapiens
tgccccacctgctgaccaccctccc

SEQ ID NO: 38658 - DNA, 22 bp, Homo sapiens
ccccacctgctgaccaccctcc

SEQ ID NO: 38659 - DNA, 24 bp, Homo sapiens
tgccccacctgctgaccaccctcc

SEQ ID NO: 38660 - DNA, 22 bp, Homo sapiens
gccccacctgctgaccaccctc

SEQ ID NO: 38661 - DNA, 22 bp, Homo sapiens
tgccccacctgctgaccaccct

SEQ ID NO: 38662 - DNA, 26 bp, Homo sapiens
gggctgccccacctgctgaccaccct

SEQ ID NO: 38663 - DNA, 21 bp, Homo sapiens
tgccccacctgctgaccaccc

SEQ ID NO: 38664 - DNA, 20 bp, Homo sapiens
tgccccacctgctgaccacc

SEQ ID NO: 38665 - DNA, 19 bp, Homo sapiens
tgccccacctgctgaccac

SEQ ID NO: 38666 - DNA, 18 bp, Homo sapiens
tgccccacctgctgacca

SEQ ID NO: 38667 - DNA, 17 bp, Homo sapiens
tgccccacctgctgacc

SEQ ID NO: 38668 - DNA, 19 bp, Homo sapiens
gccggtggggctggagtaa

SEQ ID NO: 38669 - DNA, 20 bp, Homo sapiens
agccggtggggctggagtaa

SEQ ID NO: 38670 - DNA, 24 bp, Homo sapiens
tgggagccggtggggctggagtaa

SEQ ID NO: 38671 - DNA, 17 bp, Homo sapiens
ccggtggggctggagta

SEQ ID NO: 38672 - DNA, 28 bp, Homo sapiens
gtgagtgggagccggtggggctggagta

SEQ ID NO: 38673 - DNA, 21 bp, Homo sapiens
gggagccggtggggctggagt

SEQ ID NO: 38674 - DNA, 22 bp, Homo sapiens
tgggagccggtggggctggagt

SEQ ID NO: 38675 - DNA, 27 bp, Homo sapiens
gtgagtgggagccggtggggctggagt

SEQ ID NO: 38676 - DNA, 20 bp, Homo sapiens
gggagccggtggggctggag

SEQ ID NO: 38677 - DNA, 26 bp, Homo sapiens
gtgagtgggagccggtggggctggag

SEQ ID NO: 38678 - DNA, 23 bp, Homo sapiens
tgagtgggagccggtggggctgg

SEQ ID NO: 38679 - DNA, 24 bp, Homo sapiens
gtgagtgggagccggtggggctgg

SEQ ID NO: 38680 - DNA, 21 bp, Homo sapiens
tgagtgggagccggtggggct

SEQ ID NO: 38681 - DNA, 16 bp, Homo sapiens
tgggagccggtggggc

SEQ ID NO: 38682 - DNA, 20 bp, Homo sapiens
tgagtgggagccggtggggc

SEQ ID NO: 38683 - DNA, 21 bp, Homo sapiens
gtgagtgggagccggtggggc

SEQ ID NO: 38684 - DNA, 19 bp, Homo sapiens
tgagtgggagccggtgggg

SEQ ID NO: 38685 - DNA, 18 bp, Homo sapiens
tgagtgggagccggtggg

SEQ ID NO: 38686 - DNA, 17 bp, Homo sapiens
gtgagtgggagccggtg

SEQ ID NO: 38687 - DNA, 16 bp, Homo sapiens
gtgagtgggagccggt

SEQ ID NO: 38688 - DNA, 20 bp, Homo sapiens
tggaatgtaaagaagtatgt

SEQ ID NO: 38689 - DNA, 23 bp, Homo sapiens
tggaatgtaaagaagtatgtatc

SEQ ID NO: 38690 - DNA, 24 bp, Homo sapiens
tggaatgtaaagaagtatgtatct

SEQ ID NO: 38691 - DNA, 25 bp, Homo sapiens
tggaatgtaaagaagtatgtatctc

SEQ ID NO: 38692 - DNA, 26 bp, Homo sapiens
tggaatgtaaagaagtatgtatctca

SEQ ID NO: 38693 - DNA, 28 bp, Homo sapiens
tggaatgtaaagaagtatgtatctcagg

SEQ ID NO: 38694 - DNA, 21 bp, Homo sapiens
ggaatgtaaagaagtatgtat

SEQ ID NO: 38695 - DNA, 22 bp, Homo sapiens
ggaatgtaaagaagtatgtatc

SEQ ID NO: 38696 - DNA, 23 bp, Homo sapiens
ggaatgtaaagaagtatgtatct

SEQ ID NO: 38697 - DNA, 24 bp, Homo sapiens
ggaatgtaaagaagtatgtatctc

SEQ ID NO: 38698 - DNA, 22 bp, Homo sapiens
gaatgtaaagaagtatgtatct

SEQ ID NO: 38699 - DNA, 23 bp, Homo sapiens
tttggtccccttcaaccagctgt

SEQ ID NO: 38700 - DNA, 22 bp, Homo sapiens
ttggtccccttcaaccagctgt

SEQ ID NO: 38701 - DNA, 21 bp, Homo sapiens
tggtccccttcaaccagctgt

SEQ ID NO: 38702 - DNA, 23 bp, Homo sapiens
tggtccccttcaaccagctgtag

SEQ ID NO: 38703 - DNA, 23 bp, Homo sapiens
tgcgtgttcacagcggaccttga

SEQ ID NO: 38704 - DNA, 23 bp, Homo sapiens
gcgtgttcacagcggaccttgat

SEQ ID NO: 38705 - DNA, 27 bp, Homo sapiens
ttaaggcacgcggtgaatgccaagaga

SEQ ID NO: 38706 - DNA, 26 bp, Homo sapiens
taaggcacgcggtgaatgccaagaga

SEQ ID NO: 38707 - DNA, 20 bp, Homo sapiens
ggggcggggcggcaggggcc

SEQ ID NO: 38708 - DNA, 21 bp, Homo sapiens
ggggcggggcggcaggggcct

SEQ ID NO: 38709 - DNA, 21 bp, Homo sapiens
gggcggggcggcaggggcctc

SEQ ID NO: 38710 - DNA, 18 bp, Homo sapiens
gcggggcggcaggggcct

SEQ ID NO: 38711 - DNA, 17 bp, Homo sapiens
cggggcggcaggggcct

SEQ ID NO: 38712 - DNA, 19 bp, Homo sapiens
cggggcggcaggggcctcc

SEQ ID NO: 38713 - DNA, 17 bp, Homo sapiens
ggcggcaggggcctccc

SEQ ID NO: 38714 - DNA, 19 bp, Homo sapiens
tgttcctctgtctcccaga

SEQ ID NO: 38715 - DNA, 21 bp, Homo sapiens
tgttcctctgtctcccagact

SEQ ID NO: 38716 - DNA, 22 bp, Homo sapiens
tgttcctctgtctcccagactc

SEQ ID NO: 38717 - DNA, 23 bp, Homo sapiens
tgttcctctgtctcccagactct

SEQ ID NO: 38718 - DNA, 24 bp, Homo sapiens
tgttcctctgtctcccagactctg

SEQ ID NO: 38719 - DNA, 25 bp, Homo sapiens
tgttcctctgtctcccagactctgg

SEQ ID NO: 38720 - DNA, 27 bp, Homo sapiens
tgcccagggcccgggacagcgccatgg

SEQ ID NO: 38721 - DNA, 24 bp, Homo sapiens
ccagggcccgggacagcgccatgg

SEQ ID NO: 38722 - DNA, 25 bp, Homo sapiens
ccagggcccgggacagcgccatgga

SEQ ID NO: 38723 - DNA, 26 bp, Homo sapiens
ccagggcccgggacagcgccatggaa

SEQ ID NO: 38724 - DNA, 28 bp, Homo sapiens
aggaggggtcccgcactgggaggggccc

SEQ ID NO: 38725 - DNA, 27 bp, Homo sapiens
aggaggggtcccgcactgggaggggcc

SEQ ID NO: 38726 - DNA, 21 bp, Homo sapiens
gggtcccgcactgggaggggc

SEQ ID NO: 38727 - DNA, 23 bp, Homo sapiens
aggggtcccgcactgggaggggc

SEQ ID NO: 38728 - DNA, 26 bp, Homo sapiens
aggaggggtcccgcactgggaggggc

SEQ ID NO: 38729 - DNA, 23 bp, Homo sapiens
gaggggtcccgcactgggagggg

SEQ ID NO: 38730 - DNA, 24 bp, Homo sapiens
ggaggggtcccgcactgggagggg

SEQ ID NO: 38731 - DNA, 25 bp, Homo sapiens
aggaggggtcccgcactgggagggg

SEQ ID NO: 38732 - DNA, 23 bp, Homo sapiens
ggaggggtcccgcactgggaggg

SEQ ID NO: 38733 - DNA, 24 bp, Homo sapiens
aggaggggtcccgcactgggaggg

SEQ ID NO: 38734 - DNA, 20 bp, Homo sapiens
aggggtcccgcactgggagg

SEQ ID NO: 38735 - DNA, 21 bp, Homo sapiens
gaggggtcccgcactgggagg

SEQ ID NO: 38736 - DNA, 23 bp, Homo sapiens
aggaggggtcccgcactgggagg

SEQ ID NO: 38737 - DNA, 22 bp, Homo sapiens
aggaggggtcccgcactgggag

SEQ ID NO: 38738 - DNA, 20 bp, Homo sapiens
ggaggggtcccgcactggga

SEQ ID NO: 38739 - DNA, 20 bp, Homo sapiens
agcgcaggaggggtcccgca

SEQ ID NO: 38740 - DNA, 25 bp, Homo sapiens
cctgtgcccggcccacttctgcttc

SEQ ID NO: 38741 - DNA, 26 bp, Homo sapiens
ccctgtgcccggcccacttctgcttc

SEQ ID NO: 38742 - DNA, 25 bp, Homo sapiens
ccctgtgcccggcccacttctgctt

SEQ ID NO: 38743 - DNA, 23 bp, Homo sapiens
cctgtgcccggcccacttctgct

SEQ ID NO: 38744 - DNA, 24 bp, Homo sapiens
ccctgtgcccggcccacttctgct

SEQ ID NO: 38745 - DNA, 22 bp, Homo sapiens
cctgtgcccggcccacttctgc

SEQ ID NO: 38746 - DNA, 23 bp, Homo sapiens
ccctgtgcccggcccacttctgc

SEQ ID NO: 38747 - DNA, 20 bp, Homo sapiens
cctgtgcccggcccacttct

SEQ ID NO: 38748 - DNA, 21 bp, Homo sapiens
ccctgtgcccggcccacttct

SEQ ID NO: 38749 - DNA, 19 bp, Homo sapiens
cctgtgcccggcccacttc

SEQ ID NO: 38750 - DNA, 20 bp, Homo sapiens
ccctgtgcccggcccacttc

SEQ ID NO: 38751 - DNA, 19 bp, Homo sapiens
ccctgtgcccggcccactt

SEQ ID NO: 38752 - DNA, 20 bp, Homo sapiens
tgtggctgcactcacttcct

SEQ ID NO: 38753 - DNA, 18 bp, Homo sapiens
tggcctgtggctgcactc

SEQ ID NO: 38754 - DNA, 20 bp, Homo sapiens
gcccctctccccagaccccc

SEQ ID NO: 38755 - DNA, 26 bp, Homo sapiens
aaccttggcccctctccccagacccc

SEQ ID NO: 38756 - DNA, 25 bp, Homo sapiens
aaccttggcccctctccccagaccc

SEQ ID NO: 38757 - DNA, 24 bp, Homo sapiens
aaccttggcccctctccccagacc

SEQ ID NO: 38758 - DNA, 22 bp, Homo sapiens
accttggcccctctccccagac

SEQ ID NO: 38759 - DNA, 23 bp, Homo sapiens
aaccttggcccctctccccagac

SEQ ID NO: 38760 - DNA, 21 bp, Homo sapiens
accttggcccctctccccaga

SEQ ID NO: 38761 - DNA, 22 bp, Homo sapiens
aaccttggcccctctccccaga

SEQ ID NO: 38762 - DNA, 20 bp, Homo sapiens
aaccttggcccctctcccca

SEQ ID NO: 38763 - DNA, 18 bp, Homo sapiens
aaccttggcccctctccc

SEQ ID NO: 38764 - DNA, 24 bp, Homo sapiens
caggggctggggtttcaggttctc

SEQ ID NO: 38765 - DNA, 22 bp, Homo sapiens
aggggctggggtttcaggttct

SEQ ID NO: 38766 - DNA, 21 bp, Homo sapiens
aggggctggggtttcaggttc

SEQ ID NO: 38767 - DNA, 22 bp, Homo sapiens
caggggctggggtttcaggttc

SEQ ID NO: 38768 - DNA, 23 bp, Homo sapiens
gcaggggctggggtttcaggttc

SEQ ID NO: 38769 - DNA, 20 bp, Homo sapiens
aggggctggggtttcaggtt

SEQ ID NO: 38770 - DNA, 21 bp, Homo sapiens
caggggctggggtttcaggtt

SEQ ID NO: 38771 - DNA, 20 bp, Homo sapiens
caggggctggggtttcaggt

SEQ ID NO: 38772 - DNA, 19 bp, Homo sapiens
agtgctcatttaagtagtc

SEQ ID NO: 38773 - DNA, 21 bp, Homo sapiens
agtgctcatttaagtagtctg

SEQ ID NO: 38774 - DNA, 22 bp, Homo sapiens
agtgctcatttaagtagtctga

SEQ ID NO: 38775 - DNA, 24 bp, Homo sapiens
agtgctcatttaagtagtctgatg

SEQ ID NO: 38776 - DNA, 20 bp, Homo sapiens
gtgctcatttaagtagtctg

SEQ ID NO: 38777 - DNA, 21 bp, Homo sapiens
gtgctcatttaagtagtctga

SEQ ID NO: 38778 - DNA, 20 bp, Homo sapiens
tgctcatttaagtagtctga

SEQ ID NO: 38779 - DNA, 21 bp, Homo sapiens
tgctcatttaagtagtctgat

SEQ ID NO: 38780 - DNA, 22 bp, Homo sapiens
tgctcatttaagtagtctgatg

SEQ ID NO: 38781 - DNA, 24 bp, Homo sapiens
tgctcatttaagtagtctgatgcc

SEQ ID NO: 38782 - DNA, 23 bp, Homo sapiens
gctcatttaagtagtctgatgcc

SEQ ID NO: 38783 - DNA, 20 bp, Homo sapiens
ctcatttaagtagtctgatg

SEQ ID NO: 38784 - DNA, 21 bp, Homo sapiens
ctcatttaagtagtctgatgc

SEQ ID NO: 38785 - DNA, 23 bp, Homo sapiens
ctcatttaagtagtctgatgcct

SEQ ID NO: 38786 - DNA, 21 bp, Homo sapiens
catttaagtagtctgatgcct

SEQ ID NO: 38787 - DNA, 19 bp, Homo sapiens
tctgatcaggcaaaattgc

SEQ ID NO: 38788 - DNA, 20 bp, Homo sapiens
tctgatcaggcaaaattgca

SEQ ID NO: 38789 - DNA, 21 bp, Homo sapiens
tctgatcaggcaaaattgcag

SEQ ID NO: 38790 - DNA, 22 bp, Homo sapiens
tctgatcaggcaaaattgcaga

SEQ ID NO: 38791 - DNA, 23 bp, Homo sapiens
tctgatcaggcaaaattgcagac

SEQ ID NO: 38792 - DNA, 24 bp, Homo sapiens
tctgatcaggcaaaattgcagact

SEQ ID NO: 38793 - DNA, 21 bp, Homo sapiens
ctgatcaggcaaaattgcaga

SEQ ID NO: 38794 - DNA, 23 bp, Homo sapiens
ctgatcaggcaaaattgcagact

SEQ ID NO: 38795 - DNA, 24 bp, Homo sapiens
ctgatcaggcaaaattgcagactg

SEQ ID NO: 38796 - DNA, 20 bp, Homo sapiens
tgatcaggcaaaattgcaga

SEQ ID NO: 38797 - DNA, 21 bp, Homo sapiens
tgatcaggcaaaattgcagac

SEQ ID NO: 38798 - DNA, 23 bp, Homo sapiens
tgatcaggcaaaattgcagactg

SEQ ID NO: 38799 - DNA, 24 bp, Homo sapiens
tgatcaggcaaaattgcagactgt

SEQ ID NO: 38800 - DNA, 25 bp, Homo sapiens
tgatcaggcaaaattgcagactgtc

SEQ ID NO: 38801 - DNA, 21 bp, Homo sapiens
gatcaggcaaaattgcagact

SEQ ID NO: 38802 - DNA, 16 bp, Homo sapiens
cctgcaactttgcctg

SEQ ID NO: 38803 - DNA, 19 bp, Homo sapiens
cctgcaactttgcctgatc

SEQ ID NO: 38804 - DNA, 20 bp, Homo sapiens
cctgcaactttgcctgatca

SEQ ID NO: 38805 - DNA, 21 bp, Homo sapiens
cctgcaactttgcctgatcag

SEQ ID NO: 38806 - DNA, 23 bp, Homo sapiens
cctgcaactttgcctgatcagag

SEQ ID NO: 38807 - DNA, 24 bp, Homo sapiens
cctgcaactttgcctgatcagagg

SEQ ID NO: 38808 - DNA, 21 bp, Homo sapiens
tgcaactttgcctgatcagag

SEQ ID NO: 38809 - DNA, 22 bp, Homo sapiens
tgcaactttgcctgatcagagg

SEQ ID NO: 38810 - DNA, 24 bp, Homo sapiens
cagctgtgggctcagctctgggct

SEQ ID NO: 38811 - DNA, 23 bp, Homo sapiens
cagctgtgggctcagctctgggc

SEQ ID NO: 38812 - DNA, 22 bp, Homo sapiens
cagctgtgggctcagctctggg

SEQ ID NO: 38813 - DNA, 21 bp, Homo sapiens
cagctgtgggctcagctctgg

SEQ ID NO: 38814 - DNA, 20 bp, Homo sapiens
cagctgtgggctcagctctg

SEQ ID NO: 38815 - DNA, 19 bp, Homo sapiens
cagctgtgggctcagctct

SEQ ID NO: 38816 - DNA, 16 bp, Homo sapiens
tatctagaactgggca

SEQ ID NO: 38817 - DNA, 20 bp, Homo sapiens
ttcatatctagaactgggca

SEQ ID NO: 38818 - DNA, 27 bp, Homo sapiens
tgattgtcttcatatctagaactgggc

SEQ ID NO: 38819 - DNA, 23 bp, Homo sapiens
ttgtcttcatatctagaactggg

SEQ ID NO: 38820 - DNA, 16 bp, Homo sapiens
ttcatatctagaactg

SEQ ID NO: 38821 - DNA, 24 bp, Homo sapiens
tgattgtcttcatatctagaactg

SEQ ID NO: 38822 - DNA, 21 bp, Homo sapiens
attgtcttcatatctagaact

SEQ ID NO: 38823 - DNA, 22 bp, Homo sapiens
gattgtcttcatatctagaact

SEQ ID NO: 38824 - DNA, 23 bp, Homo sapiens
tgattgtcttcatatctagaact

SEQ ID NO: 38825 - DNA, 22 bp, Homo sapiens
cttgattgtcttcatatctaga

SEQ ID NO: 38826 - DNA, 27 bp, Homo sapiens
tctggatatgaagacaatcaagaaaag

SEQ ID NO: 38827 - DNA, 26 bp, Homo sapiens
tctggatatgaagacaatcaagaaaa

SEQ ID NO: 38828 - DNA, 25 bp, Homo sapiens
tctggatatgaagacaatcaagaaa

SEQ ID NO: 38829 - DNA, 23 bp, Homo sapiens
tctggatatgaagacaatcaaga

SEQ ID NO: 38830 - DNA, 24 bp, Homo sapiens
ttctggatatgaagacaatcaaga

SEQ ID NO: 38831 - DNA, 21 bp, Homo sapiens
tctggatatgaagacaatcaa

SEQ ID NO: 38832 - DNA, 21 bp, Homo sapiens
ttctggatatgaagacaatca

SEQ ID NO: 38833 - DNA, 20 bp, Homo sapiens
ttctggatatgaagacaatc

SEQ ID NO: 38834 - DNA, 19 bp, Homo sapiens
ttctggatatgaagacaat

SEQ ID NO: 38835 - DNA, 17 bp, Homo sapiens
gcccagttctggatatg

SEQ ID NO: 38836 - DNA, 24 bp, Homo sapiens
aaaagctgggctgagaggcgactg

SEQ ID NO: 38837 - DNA, 23 bp, Homo sapiens
aaaagctgggctgagaggcgact

SEQ ID NO: 38838 - DNA, 22 bp, Homo sapiens
aaaagctgggctgagaggcgac

SEQ ID NO: 38839 - DNA, 23 bp, Homo sapiens
gaaaagctgggctgagaggcgac

SEQ ID NO: 38840 - DNA, 20 bp, Homo sapiens
aaagctgggctgagaggcga

SEQ ID NO: 38841 - DNA, 21 bp, Homo sapiens
aaaagctgggctgagaggcga

SEQ ID NO: 38842 - DNA, 22 bp, Homo sapiens
gaaaagctgggctgagaggcga

SEQ ID NO: 38843 - DNA, 19 bp, Homo sapiens
aaagctgggctgagaggcg

SEQ ID NO: 38844 - DNA, 19 bp, Homo sapiens
aaaagctgggctgagaggc

SEQ ID NO: 38845 - DNA, 18 bp, Homo sapiens
aaaagctgggctgagagg

SEQ ID NO: 38846 - DNA, 19 bp, Homo sapiens
gaaaagctgggctgagagg

SEQ ID NO: 38847 - DNA, 18 bp, Homo sapiens
aacccgtagatccgatct

SEQ ID NO: 38848 - DNA, 19 bp, Homo sapiens
aacccgtagatccgatctt

SEQ ID NO: 38849 - DNA, 20 bp, Homo sapiens
aacccgtagatccgatcttg

SEQ ID NO: 38850 - DNA, 21 bp, Homo sapiens
aacccgtagatccgatcttgt

SEQ ID NO: 38851 - DNA, 23 bp, Homo sapiens
aacccgtagatccgatcttgtgg

SEQ ID NO: 38852 - DNA, 24 bp, Homo sapiens
aacccgtagatccgatcttgtggt

SEQ ID NO: 38853 - DNA, 16 bp, Homo sapiens
caagctcgcttctatg

SEQ ID NO: 38854 - DNA, 17 bp, Homo sapiens
caagctcgcttctatgg

SEQ ID NO: 38855 - DNA, 18 bp, Homo sapiens
caagctcgcttctatggg

SEQ ID NO: 38856 - DNA, 19 bp, Homo sapiens
caagctcgcttctatgggt

SEQ ID NO: 38857 - DNA, 20 bp, Homo sapiens
caagctcgcttctatgggtc

SEQ ID NO: 38858 - DNA, 21 bp, Homo sapiens
caagctcgcttctatgggtct

SEQ ID NO: 38859 - DNA, 23 bp, Homo sapiens
caagctcgcttctatgggtctgt

SEQ ID NO: 38860 - DNA, 24 bp, Homo sapiens
caagctcgcttctatgggtctgtg

SEQ ID NO: 38861 - DNA, 25 bp, Homo sapiens
caagctcgcttctatgggtctgtgt

SEQ ID NO: 38862 - DNA, 26 bp, Homo sapiens
caagctcgcttctatgggtctgtgtc

SEQ ID NO: 38863 - DNA, 22 bp, Homo sapiens
aagctcgcttctatgggtctgt

SEQ ID NO: 38864 - DNA, 25 bp, Homo sapiens
aagctcgcttctatgggtctgtgtc

SEQ ID NO: 38865 - DNA, 19 bp, Homo sapiens
tgaggtagtaggttgtatg

SEQ ID NO: 38866 - DNA, 20 bp, Homo sapiens
tgaggtagtaggttgtatgg

SEQ ID NO: 38867 - DNA, 21 bp, Homo sapiens
tgaggtagtaggttgtatggt

SEQ ID NO: 38868 - DNA, 23 bp, Homo sapiens
tgaggtagtaggttgtatggttt

SEQ ID NO: 38869 - DNA, 24 bp, Homo sapiens
tgaggtagtaggttgtatggttta

SEQ ID NO: 38870 - DNA, 26 bp, Homo sapiens
tgaggtagtaggttgtatggtttaga

SEQ ID NO: 38871 - DNA, 27 bp, Homo sapiens
tgaggtagtaggttgtatggtttagag

SEQ ID NO: 38872 - DNA, 27 bp, Homo sapiens
agttaactgtacaaccttctagctttc

SEQ ID NO: 38873 - DNA, 25 bp, Homo sapiens
ttaactgtacaaccttctagctttc

SEQ ID NO: 38874 - DNA, 21 bp, Homo sapiens
aactgtacaaccttctagctt

SEQ ID NO: 38875 - DNA, 18 bp, Homo sapiens
ctgtacaaccttctagct

SEQ ID NO: 38876 - DNA, 19 bp, Homo sapiens
ctgtacaaccttctagctt

SEQ ID NO: 38877 - DNA, 20 bp, Homo sapiens
ctgtacaaccttctagcttt

SEQ ID NO: 38878 - DNA, 21 bp, Homo sapiens
ctgtacaaccttctagctttc

SEQ ID NO: 38879 - DNA, 23 bp, Homo sapiens
ctgtacaaccttctagctttcct

SEQ ID NO: 38880 - DNA, 24 bp, Homo sapiens
ctgtacaaccttctagctttcctt

SEQ ID NO: 38881 - DNA, 21 bp, Homo sapiens
tgtacaaccttctagctttcc

SEQ ID NO: 38882 - DNA, 22 bp, Homo sapiens
tgtacaaccttctagctttcct

SEQ ID NO: 38883 - DNA, 23 bp, Homo sapiens
tgtacaaccttctagctttcctt

SEQ ID NO: 38884 - DNA, 22 bp, Homo sapiens
caaccttctagctttccttgga

SEQ ID NO: 38885 - DNA, 22 bp, Homo sapiens
tagtccctgagaccctaacttg

SEQ ID NO: 38886 - DNA, 17 bp, Homo sapiens
tccctgagaccctaact

SEQ ID NO: 38887 - DNA, 21 bp, Homo sapiens
tccctgagaccctaacttgtg

SEQ ID NO: 38888 - DNA, 23 bp, Homo sapiens
tccctgagaccctaacttgtgag

SEQ ID NO: 38889 - DNA, 24 bp, Homo sapiens
tccctgagaccctaacttgtgagg

SEQ ID NO: 38890 - DNA, 25 bp, Homo sapiens
tccctgagaccctaacttgtgaggt

SEQ ID NO: 38891 - DNA, 21 bp, Homo sapiens
ccctgagaccctaacttgtga

SEQ ID NO: 38892 - DNA, 20 bp, Homo sapiens
ctgagaccctaacttgtgag

SEQ ID NO: 38893 - DNA, 22 bp, Homo sapiens
ctgagaccctaacttgtgaggt

SEQ ID NO: 38894 - DNA, 25 bp, Homo sapiens
ctgagaccctaacttgtgaggtatt

SEQ ID NO: 38895 - DNA, 22 bp, Homo sapiens
atcacaagtcaggctcttggga

SEQ ID NO: 38896 - DNA, 23 bp, Homo sapiens
atcacaagtcaggctcttgggac

SEQ ID NO: 38897 - DNA, 24 bp, Homo sapiens
atcacaagtcaggctcttgggacc

SEQ ID NO: 38898 - DNA, 23 bp, Homo sapiens
tcacaagtcaggctcttgggacc

SEQ ID NO: 38899 - DNA, 19 bp, Homo sapiens
acaagtcaggctcttggga

SEQ ID NO: 38900 - DNA, 20 bp, Homo sapiens
acaagtcaggctcttgggac

SEQ ID NO: 38901 - DNA, 21 bp, Homo sapiens
acaagtcaggctcttgggacc

SEQ ID NO: 38902 - DNA, 22 bp, Homo sapiens
acaagtcaggctcttgggacct

SEQ ID NO: 38903 - DNA, 23 bp, Homo sapiens
acaagtcaggctcttgggaccta

SEQ ID NO: 38904 - DNA, 24 bp, Homo sapiens
acaagtcaggctcttgggacctag

SEQ ID NO: 38905 - DNA, 25 bp, Homo sapiens
acaagtcaggctcttgggacctagg

SEQ ID NO: 38906 - DNA, 17 bp, Homo sapiens
tcaggctcttgggacct

SEQ ID NO: 38907 - DNA, 20 bp, Homo sapiens
taatggccaaaactgcagtt

SEQ ID NO: 38908 - DNA, 21 bp, Homo sapiens
taatggccaaaactgcagtta

SEQ ID NO: 38909 - DNA, 22 bp, Homo sapiens
taatggccaaaactgcagttat

SEQ ID NO: 38910 - DNA, 23 bp, Homo sapiens
taatggccaaaactgcagttatt

SEQ ID NO: 38911 - DNA, 22 bp, Homo sapiens
aatggccaaaactgcagttatt

SEQ ID NO: 38912 - DNA, 20 bp, Homo sapiens
atggccaaaactgcagttat

SEQ ID NO: 38913 - DNA, 21 bp, Homo sapiens
atggccaaaactgcagttatt

SEQ ID NO: 38914 - DNA, 22 bp, Homo sapiens
atggccaaaactgcagttattt

SEQ ID NO: 38915 - DNA, 24 bp, Homo sapiens
atggccaaaactgcagttattttt

SEQ ID NO: 38916 - DNA, 20 bp, Homo sapiens
tggccaaaactgcagttatt

SEQ ID NO: 38917 - DNA, 21 bp, Homo sapiens
tggccaaaactgcagttattt

SEQ ID NO: 38918 - DNA, 22 bp, Homo sapiens
tggccaaaactgcagttatttt

SEQ ID NO: 38919 - DNA, 22 bp, Homo sapiens
ccaaaactgcagttatttttgc

SEQ ID NO: 38920 - DNA, 25 bp, Homo sapiens
ccaaaactgcagttatttttgcacc

SEQ ID NO: 38921 - DNA, 24 bp, Homo sapiens
ggggacattcagactacctgcagc

SEQ ID NO: 38922 - DNA, 23 bp, Homo sapiens
ggggacattcagactacctgcag

SEQ ID NO: 38923 - DNA, 22 bp, Homo sapiens
ggggacattcagactacctgca

SEQ ID NO: 38924 - DNA, 21 bp, Homo sapiens
ggggacattcagactacctgc

SEQ ID NO: 38925 - DNA, 20 bp, Homo sapiens
ggggacattcagactacctg

SEQ ID NO: 38926 - DNA, 19 bp, Homo sapiens
ggggacattcagactacct

SEQ ID NO: 38927 - DNA, 20 bp, Homo sapiens
tagtggatgatgcactctgt

SEQ ID NO: 38928 - DNA, 21 bp, Homo sapiens
tagtggatgatgcactctgtg

SEQ ID NO: 38929 - DNA, 23 bp, Homo sapiens
tagtggatgatgcactctgtgca

SEQ ID NO: 38930 - DNA, 24 bp, Homo sapiens
tagtggatgatgcactctgtgcag

SEQ ID NO: 38931 - DNA, 21 bp, Homo sapiens
agtggatgatgcactctgtgc

SEQ ID NO: 38932 - DNA, 22 bp, Homo sapiens
agtggatgatgcactctgtgca

SEQ ID NO: 38933 - DNA, 20 bp, Homo sapiens
cacacagtgcttcatccact

SEQ ID NO: 38934 - DNA, 22 bp, Homo sapiens
cacacagtgcttcatccactac

SEQ ID NO: 38935 - DNA, 23 bp, Homo sapiens
cacacagtgcttcatccactact

SEQ ID NO: 38936 - DNA, 20 bp, Homo sapiens
acacagtgcttcatccacta

SEQ ID NO: 38937 - DNA, 23 bp, Homo sapiens
acacagtgcttcatccactactg

SEQ ID NO: 38938 - DNA, 18 bp, Homo sapiens
tgagggagtggattgtat

SEQ ID NO: 38939 - DNA, 20 bp, Homo sapiens
tgagggagtggattgtatgg

SEQ ID NO: 38940 - DNA, 21 bp, Homo sapiens
tgagggagtggattgtatggt

SEQ ID NO: 38941 - DNA, 17 bp, Homo sapiens
ttaatgctaatcgtgat

SEQ ID NO: 38942 - DNA, 19 bp, Homo sapiens
ttaatgctaatcgtgatag

SEQ ID NO: 38943 - DNA, 20 bp, Homo sapiens
ttaatgctaatcgtgatagg

SEQ ID NO: 38944 - DNA, 21 bp, Homo sapiens
ttaatgctaatcgtgataggg

SEQ ID NO: 38945 - DNA, 22 bp, Homo sapiens
ttaatgctaatcgtgatagggg

SEQ ID NO: 38946 - DNA, 24 bp, Homo sapiens
ttaatgctaatcgtgataggggtt

SEQ ID NO: 38947 - DNA, 25 bp, Homo sapiens
ttaatgctaatcgtgataggggttt

SEQ ID NO: 38948 - DNA, 27 bp, Homo sapiens
aactgactcctacatattagcattaac

SEQ ID NO: 38949 - DNA, 23 bp, Homo sapiens
gactcctacatattagcattaac

SEQ ID NO: 38950 - DNA, 20 bp, Homo sapiens
actcctacatattagcatta

SEQ ID NO: 38951 - DNA, 17 bp, Homo sapiens
ctcctacatattagcat

SEQ ID NO: 38952 - DNA, 18 bp, Homo sapiens
ctcctacatattagcatt

SEQ ID NO: 38953 - DNA, 19 bp, Homo sapiens
ctcctacatattagcatta

SEQ ID NO: 38954 - DNA, 20 bp, Homo sapiens
ctcctacatattagcattaa

SEQ ID NO: 38955 - DNA, 21 bp, Homo sapiens
ctcctacatattagcattaac

SEQ ID NO: 38956 - DNA, 23 bp, Homo sapiens
ctcctacatattagcattaacag

SEQ ID NO: 38957 - DNA, 24 bp, Homo sapiens
ctcctacatattagcattaacagt

SEQ ID NO: 38958 - DNA, 20 bp, Homo sapiens
cctacatattagcattaaca

SEQ ID NO: 38959 - DNA, 26 bp, Homo sapiens
ccccggtgttggggcgcgtctgccgc

SEQ ID NO: 38960 - DNA, 25 bp, Homo sapiens
ccccggtgttggggcgcgtctgccg

SEQ ID NO: 38961 - DNA, 24 bp, Homo sapiens
ccccggtgttggggcgcgtctgcc

SEQ ID NO: 38962 - DNA, 22 bp, Homo sapiens
cccggtgttggggcgcgtctgc

SEQ ID NO: 38963 - DNA, 22 bp, Homo sapiens
ccccggtgttggggcgcgtctg

SEQ ID NO: 38964 - DNA, 20 bp, Homo sapiens
cccggtgttggggcgcgtct

SEQ ID NO: 38965 - DNA, 21 bp, Homo sapiens
ccccggtgttggggcgcgtct

SEQ ID NO: 38966 - DNA, 20 bp, Homo sapiens
ccccggtgttggggcgcgtc

SEQ ID NO: 38967 - DNA, 19 bp, Homo sapiens
ccccggtgttggggcgcgt

SEQ ID NO: 38968 - DNA, 17 bp, Homo sapiens
ccccggtgttggggcgc

SEQ ID NO: 38969 - DNA, 16 bp, Homo sapiens
ccccggtgttggggcg

SEQ ID NO: 38970 - DNA, 18 bp, Homo sapiens
cagctcccgggctgattg

SEQ ID NO: 38971 - DNA, 22 bp, Homo sapiens
ggcgcgcccagctcccgggctg

SEQ ID NO: 38972 - DNA, 18 bp, Homo sapiens
gggcgcgcccagctcccg

SEQ ID NO: 38973 - DNA, 16 bp, Homo sapiens
ctcatttaggactaga

SEQ ID NO: 38974 - DNA, 17 bp, Homo sapiens
ctcatttaggactagat

SEQ ID NO: 38975 - DNA, 22 bp, Homo sapiens
gtagaggaagctgtggagagaa

SEQ ID NO: 38976 - DNA, 24 bp, Homo sapiens
gtagaggaagctgtggagagaact

SEQ ID NO: 38977 - DNA, 21 bp, Homo sapiens
tagaggaagctgtggagagaa

SEQ ID NO: 38978 - DNA, 22 bp, Homo sapiens
tagaggaagctgtggagagaac

SEQ ID NO: 38979 - DNA, 23 bp, Homo sapiens
tagaggaagctgtggagagaact

SEQ ID NO: 38980 - DNA, 25 bp, Homo sapiens
tagaggaagctgtggagagaactca

SEQ ID NO: 38981 - DNA, 26 bp, Homo sapiens
tagaggaagctgtggagagaactcac

SEQ ID NO: 38982 - DNA, 21 bp, Homo sapiens
agaggaagctgtggagagaac

SEQ ID NO: 38983 - DNA, 23 bp, Homo sapiens
tgggtaggcttgcatgggggact

SEQ ID NO: 38984 - DNA, 21 bp, Homo sapiens
tgggtaggcttgcatggggga

SEQ ID NO: 38985 - DNA, 18 bp, Homo sapiens
atgctgggactgagagtg

SEQ ID NO: 38986 - DNA, 23 bp, Homo sapiens
tgaggagatgctgggactgagag

SEQ ID NO: 38987 - DNA, 22 bp, Homo sapiens
tgaggagatgctgggactgaga

SEQ ID NO: 38988 - DNA, 23 bp, Homo sapiens
ctgaggagatgctgggactgaga

SEQ ID NO: 38989 - DNA, 21 bp, Homo sapiens
tgaggagatgctgggactgag

SEQ ID NO: 38990 - DNA, 22 bp, Homo sapiens
ctgaggagatgctgggactgag

SEQ ID NO: 38991 - DNA, 23 bp, Homo sapiens
gctgaggagatgctgggactgag

SEQ ID NO: 38992 - DNA, 22 bp, Homo sapiens
ggctgaggagatgctgggactg

SEQ ID NO: 38993 - DNA, 18 bp, Homo sapiens
ccgtgcctgaggtttctc

SEQ ID NO: 38994 - DNA, 19 bp, Homo sapiens
gccgtgcctgaggtttctc

SEQ ID NO: 38995 - DNA, 22 bp, Homo sapiens
ccggccgtgcctgaggtttctc

SEQ ID NO: 38996 - DNA, 20 bp, Homo sapiens
tgaggatatggcagggaagg

SEQ ID NO: 38997 - DNA, 21 bp, Homo sapiens
tgaggatatggcagggaaggg

SEQ ID NO: 38998 - DNA, 22 bp, Homo sapiens
tgaggatatggcagggaagggg

SEQ ID NO: 38999 - DNA, 24 bp, Homo sapiens
tgaggatatggcagggaaggggag

SEQ ID NO: 39000 - DNA, 25 bp, Homo sapiens
tgaggatatggcagggaaggggagt

SEQ ID NO: 39001 - DNA, 20 bp, Homo sapiens
ggatatggcagggaagggga

SEQ ID NO: 39002 - DNA, 24 bp, Homo sapiens
cccttccccccagtaatcttcatc

SEQ ID NO: 39003 - DNA, 23 bp, Homo sapiens
ccttccccccagtaatcttcatc

SEQ ID NO: 39004 - DNA, 20 bp, Homo sapiens
cttccccccagtaatcttca

SEQ ID NO: 39005 - DNA, 21 bp, Homo sapiens
cttccccccagtaatcttcat

SEQ ID NO: 39006 - DNA, 23 bp, Homo sapiens
cttccccccagtaatcttcatca

SEQ ID NO: 39007 - DNA, 24 bp, Homo sapiens
cttccccccagtaatcttcatcat

SEQ ID NO: 39008 - DNA, 25 bp, Homo sapiens
cttccccccagtaatcttcatcatg

SEQ ID NO: 39009 - DNA, 22 bp, Homo sapiens
ttccccccagtaatcttcatca

SEQ ID NO: 39010 - DNA, 22 bp, Homo sapiens
ccccccagtaatcttcatcatg

SEQ ID NO: 39011 - DNA, 18 bp, Homo sapiens
cacaggagttgccagggc

SEQ ID NO: 39012 - DNA, 25 bp, Homo sapiens
acaggagttgccagggctgcctttg

SEQ ID NO: 39013 - DNA, 19 bp, Homo sapiens
caggagttgccagggctgc

SEQ ID NO: 39014 - DNA, 25 bp, Homo sapiens
gagttgccagggctgcctttggtga

SEQ ID NO: 39015 - DNA, 19 bp, Homo sapiens
agttgccagggctgccttt

SEQ ID NO: 39016 - DNA, 20 bp, Homo sapiens
agttgccagggctgcctttg

SEQ ID NO: 39017 - DNA, 21 bp, Homo sapiens
agttgccagggctgcctttgg

SEQ ID NO: 39018 - DNA, 23 bp, Homo sapiens
agttgccagggctgcctttggtg

SEQ ID NO: 39019 - DNA, 24 bp, Homo sapiens
agttgccagggctgcctttggtga

SEQ ID NO: 39020 - DNA, 25 bp, Homo sapiens
agttgccagggctgcctttggtgac

SEQ ID NO: 39021 - DNA, 26 bp, Homo sapiens
agttgccagggctgcctttggtgaca

SEQ ID NO: 39022 - DNA, 25 bp, Homo sapiens
tgccagggctgcctttggtgacagc

SEQ ID NO: 39023 - DNA, 17 bp, Homo sapiens
ctgcctttggtgacagc

SEQ ID NO: 39024 - DNA, 23 bp, Homo sapiens
gagttgccagagcagcctgcggt

SEQ ID NO: 39025 - DNA, 24 bp, Homo sapiens
ttgccagagcagcctgcggtaaca

SEQ ID NO: 39026 - DNA, 24 bp, Homo sapiens
ccagagcagcctgcggtaacagta

SEQ ID NO: 39027 - DNA, 25 bp, Homo sapiens
ccagagcagcctgcggtaacagtag

SEQ ID NO: 39028 - DNA, 26 bp, Homo sapiens
ccagagcagcctgcggtaacagtagc

SEQ ID NO: 39029 - DNA, 22 bp, Homo sapiens
cagagcagcctgcggtaacagt

SEQ ID NO: 39030 - DNA, 23 bp, Homo sapiens
cagagcagcctgcggtaacagta

SEQ ID NO: 39031 - DNA, 24 bp, Homo sapiens
cagagcagcctgcggtaacagtag

SEQ ID NO: 39032 - DNA, 25 bp, Homo sapiens
cagagcagcctgcggtaacagtagc

SEQ ID NO: 39033 - DNA, 21 bp, Homo sapiens
agagcagcctgcggtaacagt

SEQ ID NO: 39034 - DNA, 24 bp, Homo sapiens
agagcagcctgcggtaacagtagc

SEQ ID NO: 39035 - DNA, 16 bp, Homo sapiens
cggtaacagtagcaat

SEQ ID NO: 39036 - DNA, 18 bp, Homo sapiens
aataaagttcatgtatgg

SEQ ID NO: 39037 - DNA, 20 bp, Homo sapiens
aataaagttcatgtatggca

SEQ ID NO: 39038 - DNA, 22 bp, Homo sapiens
aataaagttcatgtatggcaat

SEQ ID NO: 39039 - DNA, 17 bp, Homo sapiens
ataaagttcatgtatgg

SEQ ID NO: 39040 - DNA, 19 bp, Homo sapiens
cggggccgtagcactgtct

SEQ ID NO: 39041 - DNA, 20 bp, Homo sapiens
cggggccgtagcactgtctg

SEQ ID NO: 39042 - DNA, 21 bp, Homo sapiens
cggggccgtagcactgtctga

SEQ ID NO: 39043 - DNA, 22 bp, Homo sapiens
cggggccgtagcactgtctgag

SEQ ID NO: 39044 - DNA, 25 bp, Homo sapiens
cggggccgtagcactgtctgagagg

SEQ ID NO: 39045 - DNA, 26 bp, Homo sapiens
cggggccgtagcactgtctgagaggt

SEQ ID NO: 39046 - DNA, 20 bp, Homo sapiens
ggggccgtagcactgtctga

SEQ ID NO: 39047 - DNA, 22 bp, Homo sapiens
tcacagtgaaccggtctctttt

SEQ ID NO: 39048 - DNA, 23 bp, Homo sapiens
tcacagtgaaccggtctcttttt

SEQ ID NO: 39049 - DNA, 24 bp, Homo sapiens
tcacagtgaaccggtctctttttc

SEQ ID NO: 39050 - DNA, 25 bp, Homo sapiens
tcacagtgaaccggtctctttttca

SEQ ID NO: 39051 - DNA, 26 bp, Homo sapiens
tcacagtgaaccggtctctttttcag

SEQ ID NO: 39052 - DNA, 27 bp, Homo sapiens
tcacagtgaaccggtctctttttcagc

SEQ ID NO: 39053 - DNA, 21 bp, Homo sapiens
cacagtgaaccggtctctttt

SEQ ID NO: 39054 - DNA, 23 bp, Homo sapiens
cacagtgaaccggtctctttttc

SEQ ID NO: 39055 - DNA, 20 bp, Homo sapiens
acagtgaaccggtctctttt

SEQ ID NO: 39056 - DNA, 22 bp, Homo sapiens
acagtgaaccggtctctttttc

SEQ ID NO: 39057 - DNA, 19 bp, Homo sapiens
cagtgaaccggtctctttt

SEQ ID NO: 39058 - DNA, 16 bp, Homo sapiens
tgaaccggtctctttt

SEQ ID NO: 39059 - DNA, 20 bp, Homo sapiens
tcagtaacaaagattcatcc

SEQ ID NO: 39060 - DNA, 21 bp, Homo sapiens
tcagtaacaaagattcatcct

SEQ ID NO: 39061 - DNA, 22 bp, Homo sapiens
tcagtaacaaagattcatcctt

SEQ ID NO: 39062 - DNA, 23 bp, Homo sapiens
tcagtaacaaagattcatccttg

SEQ ID NO: 39063 - DNA, 21 bp, Homo sapiens
gtaacaaagattcatccttgt

SEQ ID NO: 39064 - DNA, 19 bp, Homo sapiens
tcctctagaaatgcatgac

SEQ ID NO: 39065 - DNA, 20 bp, Homo sapiens
tcctctagaaatgcatgacc

SEQ ID NO: 39066 - DNA, 21 bp, Homo sapiens
tcctctagaaatgcatgaccc

SEQ ID NO: 39067 - DNA, 22 bp, Homo sapiens
tcctctagaaatgcatgaccca

SEQ ID NO: 39068 - DNA, 23 bp, Homo sapiens
tcctctagaaatgcatgacccac

SEQ ID NO: 39069 - DNA, 24 bp, Homo sapiens
tcctctagaaatgcatgacccacc

SEQ ID NO: 39070 - DNA, 21 bp, Homo sapiens
cctctagaaatgcatgaccca

SEQ ID NO: 39071 - DNA, 22 bp, Homo sapiens
cctctagaaatgcatgacccac

SEQ ID NO: 39072 - DNA, 23 bp, Homo sapiens
cctctagaaatgcatgacccacc

SEQ ID NO: 39073 - DNA, 24 bp, Homo sapiens
cctctagaaatgcatgacccaccc

SEQ ID NO: 39074 - DNA, 20 bp, Homo sapiens
ctctagaaatgcatgaccca

SEQ ID NO: 39075 - DNA, 21 bp, Homo sapiens
ctctagaaatgcatgacccac

SEQ ID NO: 39076 - DNA, 22 bp, Homo sapiens
ctctagaaatgcatgacccacc

SEQ ID NO: 39077 - DNA, 19 bp, Homo sapiens
tctagaaatgcatgaccca

SEQ ID NO: 39078 - DNA, 23 bp, Homo sapiens
gaaatgcatgacccaccctgagt

SEQ ID NO: 39079 - DNA, 19 bp, Homo sapiens
aatgcatgacccaccctga

SEQ ID NO: 39080 - DNA, 22 bp, Homo sapiens
tggtgggccatgcatttctaga

SEQ ID NO: 39081 - DNA, 18 bp, Homo sapiens
tgggccatgcatttctag

SEQ ID NO: 39082 - DNA, 19 bp, Homo sapiens
tgggccatgcatttctaga

SEQ ID NO: 39083 - DNA, 20 bp, Homo sapiens
tgggccatgcatttctagaa

SEQ ID NO: 39084 - DNA, 21 bp, Homo sapiens
tgggccatgcatttctagaac

SEQ ID NO: 39085 - DNA, 23 bp, Homo sapiens
tgggccatgcatttctagaactc

SEQ ID NO: 39086 - DNA, 24 bp, Homo sapiens
tgggccatgcatttctagaactcc

SEQ ID NO: 39087 - DNA, 25 bp, Homo sapiens
tgggccatgcatttctagaactcct

SEQ ID NO: 39088 - DNA, 26 bp, Homo sapiens
tgggccatgcatttctagaactcctt

SEQ ID NO: 39089 - DNA, 23 bp, Homo sapiens
gctactggatgaagagtgggagt

SEQ ID NO: 39090 - DNA, 22 bp, Homo sapiens
tgtgctactggatgaagagtgg

SEQ ID NO: 39091 - DNA, 17 bp, Homo sapiens
ctctgtgctactggatg

SEQ ID NO: 39092 - DNA, 25 bp, Homo sapiens
tcagcattcattggcaccagagatg

SEQ ID NO: 39093 - DNA, 24 bp, Homo sapiens
ttcagcattcattggcaccagaga

SEQ ID NO: 39094 - DNA, 22 bp, Homo sapiens
tcagcattcattggcaccagag

SEQ ID NO: 39095 - DNA, 23 bp, Homo sapiens
ttcagcattcattggcaccagag

SEQ ID NO: 39096 - DNA, 21 bp, Homo sapiens
tcagcattcattggcaccaga

SEQ ID NO: 39097 - DNA, 21 bp, Homo sapiens
aaattcatgttcaatctaaac

SEQ ID NO: 39098 - DNA, 23 bp, Homo sapiens
tttagattgaacatgaagttaga

SEQ ID NO: 39099 - DNA, 21 bp, Homo sapiens
tttagattgaacatgaagtta

SEQ ID NO: 39100 - DNA, 22 bp, Homo sapiens
ggaggcgcaggctcggaaaggc

SEQ ID NO: 39101 - DNA, 24 bp, Homo sapiens
ggaggcgcaggctcggaaaggcgc

SEQ ID NO: 39102 - DNA, 16 bp, Homo sapiens
cggaaaggcgcgcgag

SEQ ID NO: 39103 - DNA, 25 bp, Homo sapiens
actcgcatccttcccttggcagatg

SEQ ID NO: 39104 - DNA, 24 bp, Homo sapiens
actcgcatccttcccttggcagat

SEQ ID NO: 39105 - DNA, 22 bp, Homo sapiens
ctcgcatccttcccttggcaga

SEQ ID NO: 39106 - DNA, 23 bp, Homo sapiens
actcgcatccttcccttggcaga

SEQ ID NO: 39107 - DNA, 21 bp, Homo sapiens
actcgcatccttcccttggca

SEQ ID NO: 39108 - DNA, 18 bp, Homo sapiens
actcgcatccttcccttg

SEQ ID NO: 39109 - DNA, 25 bp, Homo sapiens
tcccaagggtgagatgctgccaccc

SEQ ID NO: 39110 - DNA, 24 bp, Homo sapiens
tcccaagggtgagatgctgccacc

SEQ ID NO: 39111 - DNA, 22 bp, Homo sapiens
cccaagggtgagatgctgccac

SEQ ID NO: 39112 - DNA, 23 bp, Homo sapiens
tcccaagggtgagatgctgccac

SEQ ID NO: 39113 - DNA, 21 bp, Homo sapiens
tcccaagggtgagatgctgcc

SEQ ID NO: 39114 - DNA, 20 bp, Homo sapiens
tcccaagggtgagatgctgc

SEQ ID NO: 39115 - DNA, 19 bp, Homo sapiens
tcccaagggtgagatgctg

SEQ ID NO: 39116 - DNA, 27 bp, Homo sapiens
tgtaggtggcgccggaggagtcatttc

SEQ ID NO: 39117 - DNA, 19 bp, Homo sapiens
gtaggtggcgccggaggag

SEQ ID NO: 39118 - DNA, 20 bp, Homo sapiens
gtaggtggcgccggaggagt

SEQ ID NO: 39119 - DNA, 22 bp, Homo sapiens
gtaggtggcgccggaggagtca

SEQ ID NO: 39120 - DNA, 23 bp, Homo sapiens
gtaggtggcgccggaggagtcat

SEQ ID NO: 39121 - DNA, 24 bp, Homo sapiens
gtaggtggcgccggaggagtcatt

SEQ ID NO: 39122 - DNA, 25 bp, Homo sapiens
gtaggtggcgccggaggagtcattt

SEQ ID NO: 39123 - DNA, 26 bp, Homo sapiens
gtaggtggcgccggaggagtcatttc

SEQ ID NO: 39124 - DNA, 18 bp, Homo sapiens
taggtggcgccggaggag

SEQ ID NO: 39125 - DNA, 19 bp, Homo sapiens
taggtggcgccggaggagt

SEQ ID NO: 39126 - DNA, 20 bp, Homo sapiens
taggtggcgccggaggagtc

SEQ ID NO: 39127 - DNA, 21 bp, Homo sapiens
taggtggcgccggaggagtca

SEQ ID NO: 39128 - DNA, 22 bp, Homo sapiens
taggtggcgccggaggagtcat

SEQ ID NO: 39129 - DNA, 24 bp, Homo sapiens
taggtggcgccggaggagtcattt

SEQ ID NO: 39130 - DNA, 17 bp, Homo sapiens
aggtggcgccggaggag

SEQ ID NO: 39131 - DNA, 18 bp, Homo sapiens
aggtggcgccggaggagt

SEQ ID NO: 39132 - DNA, 20 bp, Homo sapiens
aggtggcgccggaggagtca

SEQ ID NO: 39133 - DNA, 21 bp, Homo sapiens
aggtggcgccggaggagtcat

SEQ ID NO: 39134 - DNA, 22 bp, Homo sapiens
aggtggcgccggaggagtcatt

SEQ ID NO: 39135 - DNA, 23 bp, Homo sapiens
aggtggcgccggaggagtcattt

SEQ ID NO: 39136 - DNA, 20 bp, Homo sapiens
ggtggcgccggaggagtcat

SEQ ID NO: 39137 - DNA, 21 bp, Homo sapiens
ggtggcgccggaggagtcatt

SEQ ID NO: 39138 - DNA, 20 bp, Homo sapiens
gtggcgccggaggagtcatt

SEQ ID NO: 39139 - DNA, 22 bp, Homo sapiens
gtggcgccggaggagtcatttc

SEQ ID NO: 39140 - DNA, 20 bp, Homo sapiens
cactaatggcttctcttgca

SEQ ID NO: 39141 - DNA, 21 bp, Homo sapiens
actaatggcttctcttgcaca

SEQ ID NO: 39142 - DNA, 19 bp, Homo sapiens
taatggcttctcttgcaca

SEQ ID NO: 39143 - DNA, 22 bp, Homo sapiens
taatggcttctcttgcacaccc

SEQ ID NO: 39144 - DNA, 19 bp, Homo sapiens
tggcttctcttgcacaccc

SEQ ID NO: 39145 - DNA, 20 bp, Homo sapiens
tggcttctcttgcacaccca

SEQ ID NO: 39146 - DNA, 22 bp, Homo sapiens
tggcttctcttgcacacccagg

SEQ ID NO: 39147 - DNA, 23 bp, Homo sapiens
tggcttctcttgcacacccaggg

SEQ ID NO: 39148 - DNA, 24 bp, Homo sapiens
tggcttctcttgcacacccagggc

SEQ ID NO: 39149 - DNA, 19 bp, Homo sapiens
ggtgggaaggagatgctca

SEQ ID NO: 39150 - DNA, 21 bp, Homo sapiens
ggtgggaaggagatgctcagg

SEQ ID NO: 39151 - DNA, 22 bp, Homo sapiens
gaaggagatgctcaggcagatc

SEQ ID NO: 39152 - DNA, 19 bp, Homo sapiens
aggagatgctcaggcagat

SEQ ID NO: 39153 - DNA, 21 bp, Homo sapiens
aggagatgctcaggcagatct

SEQ ID NO: 39154 - DNA, 19 bp, Homo sapiens
atctgtctcgattgtttcc

SEQ ID NO: 39155 - DNA, 20 bp, Homo sapiens
atctgtctcgattgtttcca

SEQ ID NO: 39156 - DNA, 22 bp, Homo sapiens
atctgtctcgattgtttccagg

SEQ ID NO: 39157 - DNA, 23 bp, Homo sapiens
atctgtctcgattgtttccaggg

SEQ ID NO: 39158 - DNA, 23 bp, Homo sapiens
tctgtctcgattgtttccagggc

SEQ ID NO: 39159 - DNA, 18 bp, Homo sapiens
ttgttgtctggtatgtag

SEQ ID NO: 39160 - DNA, 21 bp, Homo sapiens
gtctggtatgtagtaggtaat

SEQ ID NO: 39161 - DNA, 22 bp, Homo sapiens
gtctggtatgtagtaggtaata

SEQ ID NO: 39162 - DNA, 20 bp, Homo sapiens
tctggtatgtagtaggtaat

SEQ ID NO: 39163 - DNA, 21 bp, Homo sapiens
tctggtatgtagtaggtaata

SEQ ID NO: 39164 - DNA, 23 bp, Homo sapiens
tctggtatgtagtaggtaataac

SEQ ID NO: 39165 - DNA, 19 bp, Homo sapiens
cagacaattgcctaacatg

SEQ ID NO: 39166 - DNA, 20 bp, Homo sapiens
attgcctaacatgtgccaga

SEQ ID NO: 39167 - DNA, 22 bp, Homo sapiens
attgcctaacatgtgccagaaa

SEQ ID NO: 39168 - DNA, 19 bp, Homo sapiens
ttgcctaacatgtgccaga

SEQ ID NO: 39169 - DNA, 20 bp, Homo sapiens
ttgcctaacatgtgccagaa

SEQ ID NO: 39170 - DNA, 27 bp, Homo sapiens
tgtgcgcagggagacctctcccaccca

SEQ ID NO: 39171 - DNA, 25 bp, Homo sapiens
gtgcgcagggagacctctcccaccc

SEQ ID NO: 39172 - DNA, 23 bp, Homo sapiens
tgcgcagggagacctctcccacc

SEQ ID NO: 39173 - DNA, 25 bp, Homo sapiens
tgtgcgcagggagacctctcccacc

SEQ ID NO: 39174 - DNA, 24 bp, Homo sapiens
tgtgcgcagggagacctctcccac

SEQ ID NO: 39175 - DNA, 23 bp, Homo sapiens
tgtgcgcagggagacctctccca

SEQ ID NO: 39176 - DNA, 21 bp, Homo sapiens
tgtgcgcagggagacctctcc

SEQ ID NO: 39177 - DNA, 20 bp, Homo sapiens
tgtgcgcagggagacctctc

SEQ ID NO: 39178 - DNA, 19 bp, Homo sapiens
tgtgcgcagggagacctct

SEQ ID NO: 39179 - DNA, 18 bp, Homo sapiens
tgtgcgcagggagacctc

SEQ ID NO: 39180 - DNA, 16 bp, Homo sapiens
gtgcgcagggagacct

SEQ ID NO: 39181 - DNA, 17 bp, Homo sapiens
tgtgcgcagggagacct

SEQ ID NO: 39182 - DNA, 19 bp, Homo sapiens
taccctgtagaaccgaatt

SEQ ID NO: 39183 - DNA, 20 bp, Homo sapiens
taccctgtagaaccgaattt

SEQ ID NO: 39184 - DNA, 21 bp, Homo sapiens
taccctgtagaaccgaatttg

SEQ ID NO: 39185 - DNA, 22 bp, Homo sapiens
taccctgtagaaccgaatttgt

SEQ ID NO: 39186 - DNA, 24 bp, Homo sapiens
taccctgtagaaccgaatttgtgt

SEQ ID NO: 39187 - DNA, 27 bp, Homo sapiens
taccctgtagaaccgaatttgtgtggt

SEQ ID NO: 39188 - DNA, 21 bp, Homo sapiens
accctgtagaaccgaatttgt

SEQ ID NO: 39189 - DNA, 22 bp, Homo sapiens
accctgtagaaccgaatttgtg

SEQ ID NO: 39190 - DNA, 23 bp, Homo sapiens
accctgtagaaccgaatttgtgt

SEQ ID NO: 39191 - DNA, 22 bp, Homo sapiens
ccctgtagaaccgaatttgtgt

SEQ ID NO: 39192 - DNA, 19 bp, Homo sapiens
atagtcacagattcgattc

SEQ ID NO: 39193 - DNA, 21 bp, Homo sapiens
cacagattcgattctagggga

SEQ ID NO: 39194 - DNA, 23 bp, Homo sapiens
cacagattcgattctaggggaat

SEQ ID NO: 39195 - DNA, 20 bp, Homo sapiens
acagattcgattctagggga

SEQ ID NO: 39196 - DNA, 21 bp, Homo sapiens
acagattcgattctaggggaa

SEQ ID NO: 39197 - DNA, 23 bp, Homo sapiens
acagattcgattctaggggaata

SEQ ID NO: 39198 - DNA, 25 bp, Homo sapiens
acagattcgattctaggggaatata

SEQ ID NO: 39199 - DNA, 17 bp, Homo sapiens
cagattcgattctaggg

SEQ ID NO: 39200 - DNA, 20 bp, Homo sapiens
cagattcgattctaggggaa

SEQ ID NO: 39201 - DNA, 21 bp, Homo sapiens
cagattcgattctaggggaat

SEQ ID NO: 39202 - DNA, 22 bp, Homo sapiens
cagattcgattctaggggaata

SEQ ID NO: 39203 - DNA, 23 bp, Homo sapiens
cagattcgattctaggggaatat

SEQ ID NO: 39204 - DNA, 24 bp, Homo sapiens
cagattcgattctaggggaatata

SEQ ID NO: 39205 - DNA, 18 bp, Homo sapiens
agattcgattctagggga

SEQ ID NO: 39206 - DNA, 19 bp, Homo sapiens
agattcgattctaggggaa

SEQ ID NO: 39207 - DNA, 20 bp, Homo sapiens
agattcgattctaggggaat

SEQ ID NO: 39208 - DNA, 21 bp, Homo sapiens
agattcgattctaggggaata

SEQ ID NO: 39209 - DNA, 22 bp, Homo sapiens
agattcgattctaggggaatat

SEQ ID NO: 39210 - DNA, 23 bp, Homo sapiens
agattcgattctaggggaatata

SEQ ID NO: 39211 - DNA, 16 bp, Homo sapiens
agcggcggggtcggcg

SEQ ID NO: 39212 - DNA, 18 bp, Homo sapiens
ggcggggtcggcggcgac

SEQ ID NO: 39213 - DNA, 17 bp, Homo sapiens
gcggggtcggcggcgac

SEQ ID NO: 39214 - DNA, 18 bp, Homo sapiens
gcggggtcggcggcgacg

SEQ ID NO: 39215 - DNA, 19 bp, Homo sapiens
gcggggtcggcggcgacgt

SEQ ID NO: 39216 - DNA, 20 bp, Homo sapiens
gcggggtcggcggcgacgtg

SEQ ID NO: 39217 - DNA, 16 bp, Homo sapiens
cggggtcggcggcgac

SEQ ID NO: 39218 - DNA, 17 bp, Homo sapiens
cggggtcggcggcgacg

SEQ ID NO: 39219 - DNA, 16 bp, Homo sapiens
ggggtcggcggcgacg

SEQ ID NO: 39220 - DNA, 18 bp, Homo sapiens
ggggtcggcggcgacgtg

SEQ ID NO: 39221 - DNA, 17 bp, Homo sapiens
gggtcggcggcgacgtg

SEQ ID NO: 39222 - DNA, 16 bp, Homo sapiens
ggtcggcggcgacgtg

SEQ ID NO: 39223 - DNA, 21 bp, Homo sapiens
gatttttggagcaggagtgga

SEQ ID NO: 39224 - DNA, 22 bp, Homo sapiens
atggatttttggagcaggagtg

SEQ ID NO: 39225 - DNA, 23 bp, Homo sapiens
aatggatttttggagcaggagtg

SEQ ID NO: 39226 - DNA, 20 bp, Homo sapiens
tggatttttggagcaggagt

SEQ ID NO: 39227 - DNA, 21 bp, Homo sapiens
atggatttttggagcaggagt

SEQ ID NO: 39228 - DNA, 22 bp, Homo sapiens
aatggatttttggagcaggagt

SEQ ID NO: 39229 - DNA, 24 bp, Homo sapiens
tgaatggatttttggagcaggagt

SEQ ID NO: 39230 - DNA, 18 bp, Homo sapiens
ggatttttggagcaggag

SEQ ID NO: 39231 - DNA, 19 bp, Homo sapiens
tggatttttggagcaggag

SEQ ID NO: 39232 - DNA, 20 bp, Homo sapiens
atggatttttggagcaggag

SEQ ID NO: 39233 - DNA, 21 bp, Homo sapiens
aatggatttttggagcaggag

SEQ ID NO: 39234 - DNA, 22 bp, Homo sapiens
gaatggatttttggagcaggag

SEQ ID NO: 39235 - DNA, 23 bp, Homo sapiens
tgaatggatttttggagcaggag

SEQ ID NO: 39236 - DNA, 19 bp, Homo sapiens
atggatttttggagcagga

SEQ ID NO: 39237 - DNA, 20 bp, Homo sapiens
aatggatttttggagcagga

SEQ ID NO: 39238 - DNA, 20 bp, Homo sapiens
gaatggatttttggagcagg

SEQ ID NO: 39239 - DNA, 19 bp, Homo sapiens
gaatggatttttggagcag

SEQ ID NO: 39240 - DNA, 27 bp, Homo sapiens
tggcaagtaaaaaactctcattttcct

SEQ ID NO: 39241 - DNA, 25 bp, Homo sapiens
tggcaagtaaaaaactctcattttc

SEQ ID NO: 39242 - DNA, 26 bp, Homo sapiens
ctggcaagtaaaaaactctcattttc

SEQ ID NO: 39243 - DNA, 27 bp, Homo sapiens
tctggcaagtaaaaaactctcattttc

SEQ ID NO: 39244 - DNA, 24 bp, Homo sapiens
tggcaagtaaaaaactctcatttt

SEQ ID NO: 39245 - DNA, 23 bp, Homo sapiens
tggcaagtaaaaaactctcattt

SEQ ID NO: 39246 - DNA, 22 bp, Homo sapiens
tggcaagtaaaaaactctcatt

SEQ ID NO: 39247 - DNA, 23 bp, Homo sapiens
ctggcaagtaaaaaactctcatt

SEQ ID NO: 39248 - DNA, 21 bp, Homo sapiens
tggcaagtaaaaaactctcat

SEQ ID NO: 39249 - DNA, 22 bp, Homo sapiens
ctggcaagtaaaaaactctcat

SEQ ID NO: 39250 - DNA, 20 bp, Homo sapiens
tggcaagtaaaaaactctca

SEQ ID NO: 39251 - DNA, 22 bp, Homo sapiens
tctggcaagtaaaaaactctca

SEQ ID NO: 39252 - DNA, 21 bp, Homo sapiens
tctggcaagtaaaaaactctc

SEQ ID NO: 39253 - DNA, 18 bp, Homo sapiens
tggcaagtaaaaaactct

SEQ ID NO: 39254 - DNA, 20 bp, Homo sapiens
tctggcaagtaaaaaactct

SEQ ID NO: 39255 - DNA, 16 bp, Homo sapiens
taatggtaggagcatt

SEQ ID NO: 39256 - DNA, 17 bp, Homo sapiens
ctaatggtaggagcatt

SEQ ID NO: 39257 - DNA, 18 bp, Homo sapiens
tctaatggtaggagcatt

SEQ ID NO: 39258 - DNA, 21 bp, Homo sapiens
ccttctaatggtaggagcatt

SEQ ID NO: 39259 - DNA, 21 bp, Homo sapiens
gcccttctaatggtaggagca

SEQ ID NO: 39260 - DNA, 25 bp, Homo sapiens
ttccagcccttctaatggtaggagc

SEQ ID NO: 39261 - DNA, 26 bp, Homo sapiens
cttccagcccttctaatggtaggagc

SEQ ID NO: 39262 - DNA, 21 bp, Homo sapiens
ttcttccagcccttctaatgg

SEQ ID NO: 39263 - DNA, 21 bp, Homo sapiens
ttagaagagctggaagaaggc

SEQ ID NO: 39264 - DNA, 22 bp, Homo sapiens
attagaagagctggaagaaggc

SEQ ID NO: 39265 - DNA, 20 bp, Homo sapiens
ttagaagagctggaagaagg

SEQ ID NO: 39266 - DNA, 23 bp, Homo sapiens
accattagaagagctggaagaag

SEQ ID NO: 39267 - DNA, 24 bp, Homo sapiens
taccattagaagagctggaagaag

SEQ ID NO: 39268 - DNA, 25 bp, Homo sapiens
ttaccattagaagagctggaagaag

SEQ ID NO: 39269 - DNA, 20 bp, Homo sapiens
ccattagaagagctggaaga

SEQ ID NO: 39270 - DNA, 21 bp, Homo sapiens
accattagaagagctggaaga

SEQ ID NO: 39271 - DNA, 23 bp, Homo sapiens
ttaccattagaagagctggaaga

SEQ ID NO: 39272 - DNA, 22 bp, Homo sapiens
ttaccattagaagagctggaag

SEQ ID NO: 39273 - DNA, 19 bp, Homo sapiens
taccattagaagagctgga

SEQ ID NO: 39274 - DNA, 21 bp, Homo sapiens
tcttaccattagaagagctgg

SEQ ID NO: 39275 - DNA, 21 bp, Homo sapiens
tgctcttaccattagaagagc

SEQ ID NO: 39276 - DNA, 17 bp, Homo sapiens
aggtcgtggaagccaca

SEQ ID NO: 39277 - DNA, 20 bp, Homo sapiens
attaggtcgtggaagccaca

SEQ ID NO: 39278 - DNA, 23 bp, Homo sapiens
tggagttaggattaggtcgtgga

SEQ ID NO: 39279 - DNA, 22 bp, Homo sapiens
tggagttaggattaggtcgtgg

SEQ ID NO: 39280 - DNA, 21 bp, Homo sapiens
tggagttaggattaggtcgtg

SEQ ID NO: 39281 - DNA, 20 bp, Homo sapiens
tggagttaggattaggtcgt

SEQ ID NO: 39282 - DNA, 17 bp, Homo sapiens
gtacaaaggttcacatt

SEQ ID NO: 39283 - DNA, 23 bp, Homo sapiens
tgggctcagggtacaaaggttca

SEQ ID NO: 39284 - DNA, 22 bp, Homo sapiens
tgggctcagggtacaaaggttc

SEQ ID NO: 39285 - DNA, 24 bp, Homo sapiens
tgtgggctcagggtacaaaggttc

SEQ ID NO: 39286 - DNA, 23 bp, Homo sapiens
tgtgggctcagggtacaaaggtt

SEQ ID NO: 39287 - DNA, 22 bp, Homo sapiens
tgtgggctcagggtacaaaggt

SEQ ID NO: 39288 - DNA, 24 bp, Homo sapiens
cccttgtgggctcagggtacaaag

SEQ ID NO: 39289 - DNA, 23 bp, Homo sapiens
cccttgtgggctcagggtacaaa

SEQ ID NO: 39290 - DNA, 22 bp, Homo sapiens
cccttgtgggctcagggtacaa

SEQ ID NO: 39291 - DNA, 22 bp, Homo sapiens
catcaaggatcttaaactttgc

SEQ ID NO: 39292 - DNA, 23 bp, Homo sapiens
catcaaggatcttaaactttgcc

SEQ ID NO: 39293 - DNA, 17 bp, Homo sapiens
atcaaggatcttaaact

SEQ ID NO: 39294 - DNA, 18 bp, Homo sapiens
atcaaggatcttaaactt

SEQ ID NO: 39295 - DNA, 19 bp, Homo sapiens
atcaaggatcttaaacttt

SEQ ID NO: 39296 - DNA, 20 bp, Homo sapiens
atcaaggatcttaaactttg

SEQ ID NO: 39297 - DNA, 21 bp, Homo sapiens
atcaaggatcttaaactttgc

SEQ ID NO: 39298 - DNA, 23 bp, Homo sapiens
atcaaggatcttaaactttgcca

SEQ ID NO: 39299 - DNA, 25 bp, Homo sapiens
atcaaggatcttaaactttgccaga

SEQ ID NO: 39300 - DNA, 23 bp, Homo sapiens
gcaaagtttaagatccttgaagt

SEQ ID NO: 39301 - DNA, 20 bp, Homo sapiens
caaagtttaagatccttgaa

SEQ ID NO: 39302 - DNA, 23 bp, Homo sapiens
caaagtttaagatccttgaagtt

SEQ ID NO: 39303 - DNA, 22 bp, Homo sapiens
aaagtttaagatccttgaagtt

SEQ ID NO: 39304 - DNA, 25 bp, Homo sapiens
cagatgatctaaaggcctatacata

SEQ ID NO: 39305 - DNA, 24 bp, Homo sapiens
cagatgatctaaaggcctatacat

SEQ ID NO: 39306 - DNA, 23 bp, Homo sapiens
cagatgatctaaaggcctataca

SEQ ID NO: 39307 - DNA, 22 bp, Homo sapiens
cagatgatctaaaggcctatac

SEQ ID NO: 39308 - DNA, 21 bp, Homo sapiens
cagatgatctaaaggcctata

SEQ ID NO: 39309 - DNA, 21 bp, Homo sapiens
tcagatgatctaaaggcctat

SEQ ID NO: 39310 - DNA, 19 bp, Homo sapiens
tcagatgatctaaaggcct

SEQ ID NO: 39311 - DNA, 18 bp, Homo sapiens
tcaacatcagatgatcta

SEQ ID NO: 39312 - DNA, 18 bp, Homo sapiens
agatcacttaaagagtat

SEQ ID NO: 39313 - DNA, 23 bp, Homo sapiens
aggcctttagatcacttaaagag

SEQ ID NO: 39314 - DNA, 22 bp, Homo sapiens
aggcctttagatcacttaaaga

SEQ ID NO: 39315 - DNA, 22 bp, Homo sapiens
taggcctttagatcacttaaag

SEQ ID NO: 39316 - DNA, 21 bp, Homo sapiens
gtaggcctttagatcacttaa

SEQ ID NO: 39317 - DNA, 21 bp, Homo sapiens
ttaagtgatctaaaggcctac

SEQ ID NO: 39318 - DNA, 22 bp, Homo sapiens
ttaagtgatctaaaggcctaca

SEQ ID NO: 39319 - DNA, 23 bp, Homo sapiens
atgtaggcctttagatcacttaa

SEQ ID NO: 39320 - DNA, 24 bp, Homo sapiens
ttaagtgatctaaaggcctacata

SEQ ID NO: 39321 - DNA, 26 bp, Homo sapiens
ttaagtgatctaaaggcctacatata

SEQ ID NO: 39322 - DNA, 21 bp, Homo sapiens
tgtaggcctttagatcactta

SEQ ID NO: 39323 - DNA, 25 bp, Homo sapiens
taagtgatctaaaggcctacatata

SEQ ID NO: 39324 - DNA, 17 bp, Homo sapiens
aagtgatctaaaggcct

SEQ ID NO: 39325 - DNA, 22 bp, Homo sapiens
aagtgatctaaaggcctacata

SEQ ID NO: 39326 - DNA, 23 bp, Homo sapiens
aagtgatctaaaggcctacatat

SEQ ID NO: 39327 - DNA, 24 bp, Homo sapiens
aagtgatctaaaggcctacatata

SEQ ID NO: 39328 - DNA, 22 bp, Homo sapiens
agtgatctaaaggcctacatat

SEQ ID NO: 39329 - DNA, 20 bp, Homo sapiens
tctaggttagtgaaggctat

SEQ ID NO: 39330 - DNA, 22 bp, Homo sapiens
tctaggttagtgaaggctattt

SEQ ID NO: 39331 - DNA, 22 bp, Homo sapiens
taggttagtgaaggctatttta

SEQ ID NO: 39332 - DNA, 25 bp, Homo sapiens
ttagtgaaggctattttaatttttt

SEQ ID NO: 39333 - DNA, 17 bp, Homo sapiens
tcactacttagggtcct

SEQ ID NO: 39334 - DNA, 20 bp, Homo sapiens
ctctacactgctgcccaaga

SEQ ID NO: 39335 - DNA, 25 bp, Homo sapiens
ctaatctctacactgctgcccaaga

SEQ ID NO: 39336 - DNA, 24 bp, Homo sapiens
ctaatctctacactgctgcccaag

SEQ ID NO: 39337 - DNA, 23 bp, Homo sapiens
ctaatctctacactgctgcccaa

SEQ ID NO: 39338 - DNA, 25 bp, Homo sapiens
aactaatctctacactgctgcccaa

SEQ ID NO: 39339 - DNA, 22 bp, Homo sapiens
ctaatctctacactgctgccca

SEQ ID NO: 39340 - DNA, 24 bp, Homo sapiens
aactaatctctacactgctgccca

SEQ ID NO: 39341 - DNA, 21 bp, Homo sapiens
ctaatctctacactgctgccc

SEQ ID NO: 39342 - DNA, 23 bp, Homo sapiens
aactaatctctacactgctgccc

SEQ ID NO: 39343 - DNA, 24 bp, Homo sapiens
aaactaatctctacactgctgccc

SEQ ID NO: 39344 - DNA, 20 bp, Homo sapiens
ctaatctctacactgctgcc

SEQ ID NO: 39345 - DNA, 22 bp, Homo sapiens
aactaatctctacactgctgcc

SEQ ID NO: 39346 - DNA, 23 bp, Homo sapiens
aaactaatctctacactgctgcc

SEQ ID NO: 39347 - DNA, 19 bp, Homo sapiens
ctaatctctacactgctgc

SEQ ID NO: 39348 - DNA, 21 bp, Homo sapiens
aactaatctctacactgctgc

SEQ ID NO: 39349 - DNA, 20 bp, Homo sapiens
aactaatctctacactgctg

SEQ ID NO: 39350 - DNA, 21 bp, Homo sapiens
aaactaatctctacactgctg

SEQ ID NO: 39351 - DNA, 20 bp, Homo sapiens
aaactaatctctacactgct

SEQ ID NO: 39352 - DNA, 19 bp, Homo sapiens
aaactaatctctacactgc

SEQ ID NO: 39353 - DNA, 24 bp, Homo sapiens
agtagtgtagagattggtttgcct

SEQ ID NO: 39354 - DNA, 23 bp, Homo sapiens
agtagtgtagagattggtttgcc

SEQ ID NO: 39355 - DNA, 22 bp, Homo sapiens
agtagtgtagagattggtttgc

SEQ ID NO: 39356 - DNA, 21 bp, Homo sapiens
agtagtgtagagattggtttg

SEQ ID NO: 39357 - DNA, 22 bp, Homo sapiens
cagtagtgtagagattggtttg

SEQ ID NO: 39358 - DNA, 23 bp, Homo sapiens
gcagtagtgtagagattggtttg

SEQ ID NO: 39359 - DNA, 20 bp, Homo sapiens
agtagtgtagagattggttt

SEQ ID NO: 39360 - DNA, 19 bp, Homo sapiens
agtagtgtagagattggtt

SEQ ID NO: 39361 - DNA, 21 bp, Homo sapiens
gcagtagtgtagagattggtt

SEQ ID NO: 39362 - DNA, 20 bp, Homo sapiens
gcagtagtgtagagattggt

SEQ ID NO: 39363 - DNA, 18 bp, Homo sapiens
gcagtagtgtagagattg

SEQ ID NO: 39364 - DNA, 21 bp, Homo sapiens
acttgggcagtagtgtagaga

SEQ ID NO: 39365 - DNA, 22 bp, Homo sapiens
agcccgaggcctctgtgacgtc

SEQ ID NO: 39366 - DNA, 22 bp, Homo sapiens
gcccgaggcctctgtgacgtca

SEQ ID NO: 39367 - DNA, 21 bp, Homo sapiens
cccgaggcctctgtgacgtca

SEQ ID NO: 39368 - DNA, 22 bp, Homo sapiens
cccgaggcctctgtgacgtcac

SEQ ID NO: 39369 - DNA, 26 bp, Homo sapiens
cgaggcctctgtgacgtcacggtgtc

SEQ ID NO: 39370 - DNA, 24 bp, Homo sapiens
gaggcctctgtgacgtcacggtgt

SEQ ID NO: 39371 - DNA, 25 bp, Homo sapiens
gaggcctctgtgacgtcacggtgtc

SEQ ID NO: 39372 - DNA, 16 bp, Homo sapiens
aggcctctgtgacgtc

SEQ ID NO: 39373 - DNA, 20 bp, Homo sapiens
aggcctctgtgacgtcacgg

SEQ ID NO: 39374 - DNA, 21 bp, Homo sapiens
aggcctctgtgacgtcacggt

SEQ ID NO: 39375 - DNA, 22 bp, Homo sapiens
aggcctctgtgacgtcacggtg

SEQ ID NO: 39376 - DNA, 24 bp, Homo sapiens
aggcctctgtgacgtcacggtgtc

SEQ ID NO: 39377 - DNA, 25 bp, Homo sapiens
aggcctctgtgacgtcacggtgtct

SEQ ID NO: 39378 - DNA, 21 bp, Homo sapiens
ggcctctgtgacgtcacggtg

SEQ ID NO: 39379 - DNA, 22 bp, Homo sapiens
ggcctctgtgacgtcacggtgt

SEQ ID NO: 39380 - DNA, 21 bp, Homo sapiens
gcctctgtgacgtcacggtgt

SEQ ID NO: 39381 - DNA, 17 bp, Homo sapiens
ggagaccatgacgtcac

SEQ ID NO: 39382 - DNA, 22 bp, Homo sapiens
agaccatgacgtcacagaggct

SEQ ID NO: 39383 - DNA, 20 bp, Homo sapiens
accatgacgtcacagaggct

SEQ ID NO: 39384 - DNA, 21 bp, Homo sapiens
accatgacgtcacagaggctt

SEQ ID NO: 39385 - DNA, 22 bp, Homo sapiens
accatgacgtcacagaggcttc

SEQ ID NO: 39386 - DNA, 23 bp, Homo sapiens
accatgacgtcacagaggcttcg

SEQ ID NO: 39387 - DNA, 24 bp, Homo sapiens
accatgacgtcacagaggcttcgc

SEQ ID NO: 39388 - DNA, 22 bp, Homo sapiens
ccatgacgtcacagaggcttcg

SEQ ID NO: 39389 - DNA, 23 bp, Homo sapiens
ccatgacgtcacagaggcttcgc

SEQ ID NO: 39390 - DNA, 19 bp, Homo sapiens
catgacgtcacagaggctt

SEQ ID NO: 39391 - DNA, 20 bp, Homo sapiens
catgacgtcacagaggcttc

SEQ ID NO: 39392 - DNA, 21 bp, Homo sapiens
catgacgtcacagaggcttcg

SEQ ID NO: 39393 - DNA, 23 bp, Homo sapiens
catgacgtcacagaggcttcgcg

SEQ ID NO: 39394 - DNA, 21 bp, Homo sapiens
atgacgtcacagaggcttcgc

SEQ ID NO: 39395 - DNA, 19 bp, Homo sapiens
tgacgtcacagaggcttcg

SEQ ID NO: 39396 - DNA, 24 bp, Homo sapiens
tgacgtcacagaggcttcgcgctc

SEQ ID NO: 39397 - DNA, 16 bp, Homo sapiens
ggggggagccgcgggg

SEQ ID NO: 39398 - DNA, 17 bp, Homo sapiens
ggggggagccgcgggga

SEQ ID NO: 39399 - DNA, 18 bp, Homo sapiens
ggggggagccgcggggat

SEQ ID NO: 39400 - DNA, 19 bp, Homo sapiens
ggggggagccgcggggatc

SEQ ID NO: 39401 - DNA, 17 bp, Homo sapiens
gggggagccgcggggat

SEQ ID NO: 39402 - DNA, 18 bp, Homo sapiens
gggggagccgcggggatc

SEQ ID NO: 39403 - DNA, 19 bp, Homo sapiens
gggggagccgcggggatcg

SEQ ID NO: 39404 - DNA, 25 bp, Homo sapiens
gggggagccgcggggatcgccgagg

SEQ ID NO: 39405 - DNA, 17 bp, Homo sapiens
ggggagccgcggggatc

SEQ ID NO: 39406 - DNA, 18 bp, Homo sapiens
ggggagccgcggggatcg

SEQ ID NO: 39407 - DNA, 22 bp, Homo sapiens
ggggagccgcggggatcgccga

SEQ ID NO: 39408 - DNA, 21 bp, Homo sapiens
gggagccgcggggatcgccga

SEQ ID NO: 39409 - DNA, 27 bp, Homo sapiens
gggagccgcggggatcgccgagggccg

SEQ ID NO: 39410 - DNA, 17 bp, Homo sapiens
ggagccgcggggatcgc

SEQ ID NO: 39411 - DNA, 19 bp, Homo sapiens
ggagccgcggggatcgccg

SEQ ID NO: 39412 - DNA, 22 bp, Homo sapiens
ggagccgcggggatcgccgagg

SEQ ID NO: 39413 - DNA, 23 bp, Homo sapiens
ggagccgcggggatcgccgaggg

SEQ ID NO: 39414 - DNA, 24 bp, Homo sapiens
ggagccgcggggatcgccgagggc

SEQ ID NO: 39415 - DNA, 26 bp, Homo sapiens
ggagccgcggggatcgccgagggccg

SEQ ID NO: 39416 - DNA, 25 bp, Homo sapiens
gagccgcggggatcgccgagggccg

SEQ ID NO: 39417 - DNA, 28 bp, Homo sapiens
gagccgcggggatcgccgagggccggtc

SEQ ID NO: 39418 - DNA, 19 bp, Homo sapiens
agccgcggggatcgccgag

SEQ ID NO: 39419 - DNA, 23 bp, Homo sapiens
agccgcggggatcgccgagggcc

SEQ ID NO: 39420 - DNA, 27 bp, Homo sapiens
agccgcggggatcgccgagggccggtc

SEQ ID NO: 39421 - DNA, 17 bp, Homo sapiens
gccgcggggatcgccga

SEQ ID NO: 39422 - DNA, 20 bp, Homo sapiens
gccgcggggatcgccgaggg

SEQ ID NO: 39423 - DNA, 21 bp, Homo sapiens
gccgcggggatcgccgagggc

SEQ ID NO: 39424 - DNA, 22 bp, Homo sapiens
gccgcggggatcgccgagggcc

SEQ ID NO: 39425 - DNA, 26 bp, Homo sapiens
gccgcggggatcgccgagggccggtc

SEQ ID NO: 39426 - DNA, 17 bp, Homo sapiens
ccgcggggatcgccgag

SEQ ID NO: 39427 - DNA, 21 bp, Homo sapiens
ccgcggggatcgccgagggcc

SEQ ID NO: 39428 - DNA, 22 bp, Homo sapiens
ccgcggggatcgccgagggccg

SEQ ID NO: 39429 - DNA, 25 bp, Homo sapiens
ccgcggggatcgccgagggccggtc

SEQ ID NO: 39430 - DNA, 20 bp, Homo sapiens
cgcggggatcgccgagggcc

SEQ ID NO: 39431 - DNA, 24 bp, Homo sapiens
cgcggggatcgccgagggccggtc

SEQ ID NO: 39432 - DNA, 22 bp, Homo sapiens
gcggggatcgccgagggccggt

SEQ ID NO: 39433 - DNA, 23 bp, Homo sapiens
gcggggatcgccgagggccggtc

SEQ ID NO: 39434 - DNA, 18 bp, Homo sapiens
cggggatcgccgagggcc

SEQ ID NO: 39435 - DNA, 21 bp, Homo sapiens
ggggatcgccgagggccggtc

SEQ ID NO: 39436 - DNA, 16 bp, Homo sapiens
gggatcgccgagggcc

SEQ ID NO: 39437 - DNA, 17 bp, Homo sapiens
gggatcgccgagggccg

SEQ ID NO: 39438 - DNA, 20 bp, Homo sapiens
gggatcgccgagggccggtc

SEQ ID NO: 39439 - DNA, 19 bp, Homo sapiens
ggatcgccgagggccggtc

SEQ ID NO: 39440 - DNA, 18 bp, Homo sapiens
gatcgccgagggccggtc

SEQ ID NO: 39441 - DNA, 16 bp, Homo sapiens
atcgccgagggccggt

SEQ ID NO: 39442 - DNA, 17 bp, Homo sapiens
atcgccgagggccggtc

SEQ ID NO: 39443 - DNA, 16 bp, Homo sapiens
tcgccgagggccggtc

SEQ ID NO: 39444 - DNA, 16 bp, Homo sapiens
gtccctcccggacagg

SEQ ID NO: 39445 - DNA, 17 bp, Homo sapiens
gtccctcccggacaggc

SEQ ID NO: 39446 - DNA, 19 bp, Homo sapiens
gtccctcccggacaggcgt

SEQ ID NO: 39447 - DNA, 20 bp, Homo sapiens
gtccctcccggacaggcgtt

SEQ ID NO: 39448 - DNA, 22 bp, Homo sapiens
gtccctcccggacaggcgttcg

SEQ ID NO: 39449 - DNA, 24 bp, Homo sapiens
gtccctcccggacaggcgttcgtg

SEQ ID NO: 39450 - DNA, 22 bp, Homo sapiens
tccctcccggacaggcgttcgt

SEQ ID NO: 39451 - DNA, 22 bp, Homo sapiens
ccctcccggacaggcgttcgtg

SEQ ID NO: 39452 - DNA, 25 bp, Homo sapiens
ccctcccggacaggcgttcgtgcga

SEQ ID NO: 39453 - DNA, 26 bp, Homo sapiens
ccctcccggacaggcgttcgtgcgac

SEQ ID NO: 39454 - DNA, 21 bp, Homo sapiens
cctcccggacaggcgttcgtg

SEQ ID NO: 39455 - DNA, 25 bp, Homo sapiens
cctcccggacaggcgttcgtgcgac

SEQ ID NO: 39456 - DNA, 19 bp, Homo sapiens
ctcccggacaggcgttcgt

SEQ ID NO: 39457 - DNA, 22 bp, Homo sapiens
ctcccggacaggcgttcgtgcg

SEQ ID NO: 39458 - DNA, 25 bp, Homo sapiens
ctcccggacaggcgttcgtgcgacg

SEQ ID NO: 39459 - DNA, 27 bp, Homo sapiens
ctcccggacaggcgttcgtgcgacgtg

SEQ ID NO: 39460 - DNA, 22 bp, Homo sapiens
tcccggacaggcgttcgtgcga

SEQ ID NO: 39461 - DNA, 26 bp, Homo sapiens
tcccggacaggcgttcgtgcgacgtg

SEQ ID NO: 39462 - DNA, 22 bp, Homo sapiens
cccggacaggcgttcgtgcgac

SEQ ID NO: 39463 - DNA, 25 bp, Homo sapiens
cccggacaggcgttcgtgcgacgtg

SEQ ID NO: 39464 - DNA, 26 bp, Homo sapiens
cccggacaggcgttcgtgcgacgtgt

SEQ ID NO: 39465 - DNA, 27 bp, Homo sapiens
cccggacaggcgttcgtgcgacgtgtg

SEQ ID NO: 39466 - DNA, 21 bp, Homo sapiens
ccggacaggcgttcgtgcgac

SEQ ID NO: 39467 - DNA, 23 bp, Homo sapiens
ccggacaggcgttcgtgcgacgt

SEQ ID NO: 39468 - DNA, 26 bp, Homo sapiens
ccggacaggcgttcgtgcgacgtgtg

SEQ ID NO: 39469 - DNA, 17 bp, Homo sapiens
cggacaggcgttcgtgc

SEQ ID NO: 39470 - DNA, 19 bp, Homo sapiens
cggacaggcgttcgtgcga

SEQ ID NO: 39471 - DNA, 20 bp, Homo sapiens
cggacaggcgttcgtgcgac

SEQ ID NO: 39472 - DNA, 21 bp, Homo sapiens
cggacaggcgttcgtgcgacg

SEQ ID NO: 39473 - DNA, 22 bp, Homo sapiens
cggacaggcgttcgtgcgacgt

SEQ ID NO: 39474 - DNA, 26 bp, Homo sapiens
cggacaggcgttcgtgcgacgtgtgg

SEQ ID NO: 39475 - DNA, 28 bp, Homo sapiens
cggacaggcgttcgtgcgacgtgtggcg

SEQ ID NO: 39476 - DNA, 19 bp, Homo sapiens
ggacaggcgttcgtgcgac

SEQ ID NO: 39477 - DNA, 23 bp, Homo sapiens
ggacaggcgttcgtgcgacgtgt

SEQ ID NO: 39478 - DNA, 27 bp, Homo sapiens
ggacaggcgttcgtgcgacgtgtggcg

SEQ ID NO: 39479 - DNA, 18 bp, Homo sapiens
gacaggcgttcgtgcgac

SEQ ID NO: 39480 - DNA, 21 bp, Homo sapiens
gacaggcgttcgtgcgacgtg

SEQ ID NO: 39481 - DNA, 23 bp, Homo sapiens
gacaggcgttcgtgcgacgtgtg

SEQ ID NO: 39482 - DNA, 24 bp, Homo sapiens
gacaggcgttcgtgcgacgtgtgg

SEQ ID NO: 39483 - DNA, 25 bp, Homo sapiens
gacaggcgttcgtgcgacgtgtggc

SEQ ID NO: 39484 - DNA, 26 bp, Homo sapiens
gacaggcgttcgtgcgacgtgtggcg

SEQ ID NO: 39485 - DNA, 17 bp, Homo sapiens
acaggcgttcgtgcgac

SEQ ID NO: 39486 - DNA, 20 bp, Homo sapiens
acaggcgttcgtgcgacgtg

SEQ ID NO: 39487 - DNA, 22 bp, Homo sapiens
acaggcgttcgtgcgacgtgtg

SEQ ID NO: 39488 - DNA, 25 bp, Homo sapiens
acaggcgttcgtgcgacgtgtggcg

SEQ ID NO: 39489 - DNA, 24 bp, Homo sapiens
caggcgttcgtgcgacgtgtggcg

SEQ ID NO: 39490 - DNA, 21 bp, Homo sapiens
aggcgttcgtgcgacgtgtgg

SEQ ID NO: 39491 - DNA, 22 bp, Homo sapiens
ggcgttcgtgcgacgtgtggcg

SEQ ID NO: 39492 - DNA, 19 bp, Homo sapiens
gcgttcgtgcgacgtgtgg

SEQ ID NO: 39493 - DNA, 21 bp, Homo sapiens
gcgttcgtgcgacgtgtggcg

SEQ ID NO: 39494 - DNA, 19 bp, Homo sapiens
gttcgtgcgacgtgtggcg

SEQ ID NO: 39495 - DNA, 17 bp, Homo sapiens
tcgtgcgacgtgtggcg

SEQ ID NO: 39496 - DNA, 16 bp, Homo sapiens
cgtgcgacgtgtggcg

SEQ ID NO: 39497 - DNA, 22 bp, Homo sapiens
tacccagtctccggtgcagcct

SEQ ID NO: 39498 - DNA, 23 bp, Homo sapiens
tacccagtctccggtgcagcctt

SEQ ID NO: 39499 - DNA, 24 bp, Homo sapiens
tacccagtctccggtgcagccttg

SEQ ID NO: 39500 - DNA, 25 bp, Homo sapiens
tacccagtctccggtgcagccttga

SEQ ID NO: 39501 - DNA, 26 bp, Homo sapiens
tacccagtctccggtgcagccttgac

SEQ ID NO: 39502 - DNA, 22 bp, Homo sapiens
acccagtctccggtgcagcctt

SEQ ID NO: 39503 - DNA, 26 bp, Homo sapiens
tacccagtctccggtgcagcctgttg

SEQ ID NO: 39504 - DNA, 25 bp, Homo sapiens
tacccagtctccggtgcagcctgtt

SEQ ID NO: 39505 - DNA, 23 bp, Homo sapiens
acccagtctccggtgcagcctgt

SEQ ID NO: 39506 - DNA, 24 bp, Homo sapiens
tacccagtctccggtgcagcctgt

SEQ ID NO: 39507 - DNA, 23 bp, Homo sapiens
tacccagtctccggtgcagcctg

SEQ ID NO: 39508 - DNA, 22 bp, Homo sapiens
gctgcaccggagactgggtaag

SEQ ID NO: 39509 - DNA, 22 bp, Homo sapiens
ctgcaccggagactgggtaaga

SEQ ID NO: 39510 - DNA, 17 bp, Homo sapiens
agactgggtaagacatg

SEQ ID NO: 39511 - DNA, 25 bp, Homo sapiens
tgtccttgctgtttggagataatac

SEQ ID NO: 39512 - DNA, 24 bp, Homo sapiens
tgtccttgctgtttggagataata

SEQ ID NO: 39513 - DNA, 25 bp, Homo sapiens
ttgtccttgctgtttggagataata

SEQ ID NO: 39514 - DNA, 26 bp, Homo sapiens
attgtccttgctgtttggagataata

SEQ ID NO: 39515 - DNA, 23 bp, Homo sapiens
tgtccttgctgtttggagataat

SEQ ID NO: 39516 - DNA, 25 bp, Homo sapiens
attgtccttgctgtttggagataat

SEQ ID NO: 39517 - DNA, 22 bp, Homo sapiens
tgtccttgctgtttggagataa

SEQ ID NO: 39518 - DNA, 21 bp, Homo sapiens
tgtccttgctgtttggagata

SEQ ID NO: 39519 - DNA, 22 bp, Homo sapiens
ttgtccttgctgtttggagata

SEQ ID NO: 39520 - DNA, 23 bp, Homo sapiens
attgtccttgctgtttggagata

SEQ ID NO: 39521 - DNA, 20 bp, Homo sapiens
tgtccttgctgtttggagat

SEQ ID NO: 39522 - DNA, 21 bp, Homo sapiens
ttgtccttgctgtttggagat

SEQ ID NO: 39523 - DNA, 21 bp, Homo sapiens
attgtccttgctgtttggaga

SEQ ID NO: 39524 - DNA, 26 bp, Homo sapiens
atccccagatacaatggacaatatgc

SEQ ID NO: 39525 - DNA, 25 bp, Homo sapiens
atccccagatacaatggacaatatg

SEQ ID NO: 39526 - DNA, 24 bp, Homo sapiens
atccccagatacaatggacaatat

SEQ ID NO: 39527 - DNA, 20 bp, Homo sapiens
cccagatacaatggacaata

SEQ ID NO: 39528 - DNA, 23 bp, Homo sapiens
atccccagatacaatggacaata

SEQ ID NO: 39529 - DNA, 22 bp, Homo sapiens
atccccagatacaatggacaat

SEQ ID NO: 39530 - DNA, 20 bp, Homo sapiens
atccccagatacaatggaca

SEQ ID NO: 39531 - DNA, 19 bp, Homo sapiens
atccccagatacaatggac

SEQ ID NO: 39532 - DNA, 17 bp, Homo sapiens
atccccagatacaatgg

SEQ ID NO: 39533 - DNA, 16 bp, Homo sapiens
gagcgcaagggacagg

SEQ ID NO: 39534 - DNA, 18 bp, Homo sapiens
gagcgcaagggacaggga

SEQ ID NO: 39535 - DNA, 19 bp, Homo sapiens
gagcgcaagggacagggag

SEQ ID NO: 39536 - DNA, 20 bp, Homo sapiens
gagcgcaagggacagggagg

SEQ ID NO: 39537 - DNA, 23 bp, Homo sapiens
gagcgcaagggacagggagggtc

SEQ ID NO: 39538 - DNA, 24 bp, Homo sapiens
gagcgcaagggacagggagggtcg

SEQ ID NO: 39539 - DNA, 26 bp, Homo sapiens
gagcgcaagggacagggagggtcgtg

SEQ ID NO: 39540 - DNA, 17 bp, Homo sapiens
agcgcaagggacaggga

SEQ ID NO: 39541 - DNA, 18 bp, Homo sapiens
agcgcaagggacagggag

SEQ ID NO: 39542 - DNA, 21 bp, Homo sapiens
agcgcaagggacagggagggt

SEQ ID NO: 39543 - DNA, 22 bp, Homo sapiens
agcgcaagggacagggagggtc

SEQ ID NO: 39544 - DNA, 23 bp, Homo sapiens
agcgcaagggacagggagggtcg

SEQ ID NO: 39545 - DNA, 25 bp, Homo sapiens
agcgcaagggacagggagggtcgtg

SEQ ID NO: 39546 - DNA, 17 bp, Homo sapiens
gcgcaagggacagggag

SEQ ID NO: 39547 - DNA, 18 bp, Homo sapiens
gcgcaagggacagggagg

SEQ ID NO: 39548 - DNA, 21 bp, Homo sapiens
gcgcaagggacagggagggtc

SEQ ID NO: 39549 - DNA, 24 bp, Homo sapiens
gcgcaagggacagggagggtcgtg

SEQ ID NO: 39550 - DNA, 25 bp, Homo sapiens
gcgcaagggacagggagggtcgtgg

SEQ ID NO: 39551 - DNA, 21 bp, Homo sapiens
cgcaagggacagggagggtcg

SEQ ID NO: 39552 - DNA, 22 bp, Homo sapiens
cgcaagggacagggagggtcgt

SEQ ID NO: 39553 - DNA, 23 bp, Homo sapiens
cgcaagggacagggagggtcgtg

SEQ ID NO: 39554 - DNA, 20 bp, Homo sapiens
gcaagggacagggagggtcg

SEQ ID NO: 39555 - DNA, 21 bp, Homo sapiens
gcaagggacagggagggtcgt

SEQ ID NO: 39556 - DNA, 22 bp, Homo sapiens
gcaagggacagggagggtcgtg

SEQ ID NO: 39557 - DNA, 21 bp, Homo sapiens
caagggacagggagggtcgtg

SEQ ID NO: 39558 - DNA, 24 bp, Homo sapiens
caagggacagggagggtcgtggcg

SEQ ID NO: 39559 - DNA, 22 bp, Homo sapiens
aagggacagggagggtcgtggc

SEQ ID NO: 39560 - DNA, 23 bp, Homo sapiens
aagggacagggagggtcgtggcg

SEQ ID NO: 39561 - DNA, 17 bp, Homo sapiens
agggacagggagggtcg

SEQ ID NO: 39562 - DNA, 18 bp, Homo sapiens
agggacagggagggtcgt

SEQ ID NO: 39563 - DNA, 20 bp, Homo sapiens
agggacagggagggtcgtgg

SEQ ID NO: 39564 - DNA, 21 bp, Homo sapiens
agggacagggagggtcgtggc

SEQ ID NO: 39565 - DNA, 23 bp, Homo sapiens
agggacagggagggtcgtggcga

SEQ ID NO: 39566 - DNA, 21 bp, Homo sapiens
cagggagggtcgtggcgacac

SEQ ID NO: 39567 - DNA, 20 bp, Homo sapiens
agggagggtcgtggcgacac

SEQ ID NO: 39568 - DNA, 17 bp, Homo sapiens
gagggtcgtggcgacac

SEQ ID NO: 39569 - DNA, 26 bp, Homo sapiens
ttgggacatacttatgctaaaatatt

SEQ ID NO: 39570 - DNA, 22 bp, Homo sapiens
agcttttaattttttgtttcgg

SEQ ID NO: 39571 - DNA, 24 bp, Homo sapiens
agcttttaattttttgtttcggtc

SEQ ID NO: 39572 - DNA, 25 bp, Homo sapiens
agcttttaattttttgtttcggtca

SEQ ID NO: 39573 - DNA, 28 bp, Homo sapiens
gcttttaattttttgtttcggtcactct

SEQ ID NO: 39574 - DNA, 23 bp, Homo sapiens
cttttaattttttgtttcggtca

SEQ ID NO: 39575 - DNA, 22 bp, Homo sapiens
ttttaattttttgtttcggtca

SEQ ID NO: 39576 - DNA, 25 bp, Homo sapiens
ttttaattttttgtttcggtcactc

SEQ ID NO: 39577 - DNA, 20 bp, Homo sapiens
ttaattttttgtttcggtca

SEQ ID NO: 39578 - DNA, 21 bp, Homo sapiens
ttaattttttgtttcggtcac

SEQ ID NO: 39579 - DNA, 23 bp, Homo sapiens
ttaattttttgtttcggtcactc

SEQ ID NO: 39580 - DNA, 24 bp, Homo sapiens
ttaattttttgtttcggtcactct

SEQ ID NO: 39581 - DNA, 20 bp, Homo sapiens
taattttttgtttcggtcac

SEQ ID NO: 39582 - DNA, 21 bp, Homo sapiens
taattttttgtttcggtcact

SEQ ID NO: 39583 - DNA, 16 bp, Homo sapiens
tccactgcatatagcc

SEQ ID NO: 39584 - DNA, 25 bp, Homo sapiens
gtggaccaggatggcaagggctctc

SEQ ID NO: 39585 - DNA, 24 bp, Homo sapiens
tggaccaggatggcaagggctctc

SEQ ID NO: 39586 - DNA, 19 bp, Homo sapiens
agagcccttgccatcctgg

SEQ ID NO: 39587 - DNA, 17 bp, Homo sapiens
agagcccttgccatcct

SEQ ID NO: 39588 - DNA, 24 bp, Homo sapiens
accaggatggcaagggctctactg

SEQ ID NO: 39589 - DNA, 25 bp, Homo sapiens
ggaccaggatggcaagggctctact

SEQ ID NO: 39590 - DNA, 27 bp, Homo sapiens
gtggaccaggatggcaagggctctact

SEQ ID NO: 39591 - DNA, 22 bp, Homo sapiens
accaggatggcaagggctctac

SEQ ID NO: 39592 - DNA, 18 bp, Homo sapiens
ggtccactgcatatagtc

SEQ ID NO: 39593 - DNA, 23 bp, Homo sapiens
cacaggcttagaaaagacagtct

SEQ ID NO: 39594 - DNA, 16 bp, Homo sapiens
ggttctgtggagtcct

SEQ ID NO: 39595 - DNA, 24 bp, Homo sapiens
cttctcttctctccttcccagggc

SEQ ID NO: 39596 - DNA, 23 bp, Homo sapiens
cttctcttctctccttcccaggg

SEQ ID NO: 39597 - DNA, 22 bp, Homo sapiens
cttctcttctctccttcccagg

SEQ ID NO: 39598 - DNA, 24 bp, Homo sapiens
tggcaaggaaagaagaggatcatg

SEQ ID NO: 39599 - DNA, 25 bp, Homo sapiens
ttggcaaggaaagaagaggatcatg

SEQ ID NO: 39600 - DNA, 23 bp, Homo sapiens
tggcaaggaaagaagaggatcat

SEQ ID NO: 39601 - DNA, 24 bp, Homo sapiens
ttggcaaggaaagaagaggatcat

SEQ ID NO: 39602 - DNA, 23 bp, Homo sapiens
ttggcaaggaaagaagaggatca

SEQ ID NO: 39603 - DNA, 21 bp, Homo sapiens
tggcaaggaaagaagaggatc

SEQ ID NO: 39604 - DNA, 22 bp, Homo sapiens
ttggcaaggaaagaagaggatc

SEQ ID NO: 39605 - DNA, 20 bp, Homo sapiens
tggcaaggaaagaagaggat

SEQ ID NO: 39606 - DNA, 21 bp, Homo sapiens
ttggcaaggaaagaagaggat

SEQ ID NO: 39607 - DNA, 20 bp, Homo sapiens
ttggcaaggaaagaagagga

SEQ ID NO: 39608 - DNA, 18 bp, Homo sapiens
tggcaaggaaagaagagg

SEQ ID NO: 39609 - DNA, 24 bp, Homo sapiens
tcaagtgtcatctgtccctaggcc

SEQ ID NO: 39610 - DNA, 22 bp, Homo sapiens
caagtgtcatctgtccctaggc

SEQ ID NO: 39611 - DNA, 23 bp, Homo sapiens
tcaagtgtcatctgtccctaggc

SEQ ID NO: 39612 - DNA, 20 bp, Homo sapiens
aagtgtcatctgtccctagg

SEQ ID NO: 39613 - DNA, 22 bp, Homo sapiens
tcaagtgtcatctgtccctagg

SEQ ID NO: 39614 - DNA, 23 bp, Homo sapiens
gtcaagtgtcatctgtccctagg

SEQ ID NO: 39615 - DNA, 20 bp, Homo sapiens
caagtgtcatctgtccctag

SEQ ID NO: 39616 - DNA, 22 bp, Homo sapiens
gtcaagtgtcatctgtccctag

SEQ ID NO: 39617 - DNA, 27 bp, Homo sapiens
gctgagtcaagtgtcatctgtccctag

SEQ ID NO: 39618 - DNA, 20 bp, Homo sapiens
tcaagtgtcatctgtcccta

SEQ ID NO: 39619 - DNA, 21 bp, Homo sapiens
gtcaagtgtcatctgtcccta

SEQ ID NO: 39620 - DNA, 19 bp, Homo sapiens
tcaagtgtcatctgtccct

SEQ ID NO: 39621 - DNA, 20 bp, Homo sapiens
gacgccacatgtctcaggtc

SEQ ID NO: 39622 - DNA, 24 bp, Homo sapiens
tgggattgacgccacatgtctcag

SEQ ID NO: 39623 - DNA, 23 bp, Homo sapiens
tgggattgacgccacatgtctca

SEQ ID NO: 39624 - DNA, 24 bp, Homo sapiens
ttgggattgacgccacatgtctca

SEQ ID NO: 39625 - DNA, 21 bp, Homo sapiens
gggattgacgccacatgtctc

SEQ ID NO: 39626 - DNA, 22 bp, Homo sapiens
tgggattgacgccacatgtctc

SEQ ID NO: 39627 - DNA, 23 bp, Homo sapiens
ttgggattgacgccacatgtctc

SEQ ID NO: 39628 - DNA, 24 bp, Homo sapiens
tttgggattgacgccacatgtctc

SEQ ID NO: 39629 - DNA, 21 bp, Homo sapiens
tgggattgacgccacatgtct

SEQ ID NO: 39630 - DNA, 22 bp, Homo sapiens
ttgggattgacgccacatgtct

SEQ ID NO: 39631 - DNA, 20 bp, Homo sapiens
tgggattgacgccacatgtc

SEQ ID NO: 39632 - DNA, 21 bp, Homo sapiens
ttgggattgacgccacatgtc

SEQ ID NO: 39633 - DNA, 22 bp, Homo sapiens
tttgggattgacgccacatgtc

SEQ ID NO: 39634 - DNA, 19 bp, Homo sapiens
tgggattgacgccacatgt

SEQ ID NO: 39635 - DNA, 20 bp, Homo sapiens
ttgggattgacgccacatgt

SEQ ID NO: 39636 - DNA, 21 bp, Homo sapiens
tttgggattgacgccacatgt

SEQ ID NO: 39637 - DNA, 20 bp, Homo sapiens
tttgggattgacgccacatg

SEQ ID NO: 39638 - DNA, 17 bp, Homo sapiens
tgggattgacgccacat

SEQ ID NO: 39639 - DNA, 21 bp, Homo sapiens
atggggacagggatcagcatg

SEQ ID NO: 39640 - DNA, 22 bp, Homo sapiens
atggggacagggatcagcatgg

SEQ ID NO: 39641 - DNA, 24 bp, Homo sapiens
atggggacagggatcagcatggca

SEQ ID NO: 39642 - DNA, 25 bp, Homo sapiens
atggggacagggatcagcatggcac

SEQ ID NO: 39643 - DNA, 26 bp, Homo sapiens
atggggacagggatcagcatggcaca

SEQ ID NO: 39644 - DNA, 21 bp, Homo sapiens
tggggacagggatcagcatgg

SEQ ID NO: 39645 - DNA, 23 bp, Homo sapiens
tggggacagggatcagcatggca

SEQ ID NO: 39646 - DNA, 24 bp, Homo sapiens
tggggacagggatcagcatggcac

SEQ ID NO: 39647 - DNA, 25 bp, Homo sapiens
tggggacagggatcagcatggcaca

SEQ ID NO: 39648 - DNA, 24 bp, Homo sapiens
ggggacagggatcagcatggcaca

SEQ ID NO: 39649 - DNA, 19 bp, Homo sapiens
tcccctgctcccttgttcc

SEQ ID NO: 39650 - DNA, 21 bp, Homo sapiens
tcccctgctcccttgttcccc

SEQ ID NO: 39651 - DNA, 22 bp, Homo sapiens
tcccctgctcccttgttcccca

SEQ ID NO: 39652 - DNA, 24 bp, Homo sapiens
tcccctgctcccttgttccccagt

SEQ ID NO: 39653 - DNA, 25 bp, Homo sapiens
tcccctgctcccttgttccccagtc

SEQ ID NO: 39654 - DNA, 27 bp, Homo sapiens
tcccctgctcccttgttccccagtccc

SEQ ID NO: 39655 - DNA, 23 bp, Homo sapiens
cccctgctcccttgttccccagt

SEQ ID NO: 39656 - DNA, 20 bp, Homo sapiens
ctgctcccttgttccccagt

SEQ ID NO: 39657 - DNA, 20 bp, Homo sapiens
ttcaagtaattcaggatagg

SEQ ID NO: 39658 - DNA, 22 bp, Homo sapiens
ttcaagtaattcaggataggtt

SEQ ID NO: 39659 - DNA, 23 bp, Homo sapiens
ttcaagtaattcaggataggttg

SEQ ID NO: 39660 - DNA, 24 bp, Homo sapiens
ttcaagtaattcaggataggttgt

SEQ ID NO: 39661 - DNA, 26 bp, Homo sapiens
ttcaagtaattcaggataggttgtgt

SEQ ID NO: 39662 - DNA, 22 bp, Homo sapiens
gcctgttctccattacttggct

SEQ ID NO: 39663 - DNA, 23 bp, Homo sapiens
gcctgttctccattacttggctc

SEQ ID NO: 39664 - DNA, 19 bp, Homo sapiens
cctgttctccattacttgg

SEQ ID NO: 39665 - DNA, 20 bp, Homo sapiens
cctgttctccattacttggc

SEQ ID NO: 39666 - DNA, 21 bp, Homo sapiens
cctgttctccattacttggct

SEQ ID NO: 39667 - DNA, 23 bp, Homo sapiens
cctgttctccattacttggctcg

SEQ ID NO: 39668 - DNA, 20 bp, Homo sapiens
ctgttctccattacttggct

SEQ ID NO: 39669 - DNA, 24 bp, Homo sapiens
tttgttcgttcggctcgcgtgagg

SEQ ID NO: 39670 - DNA, 23 bp, Homo sapiens
tttgttcgttcggctcgcgtgag

SEQ ID NO: 39671 - DNA, 21 bp, Homo sapiens
ttgttcgttcggctcgcgtga

SEQ ID NO: 39672 - DNA, 23 bp, Homo sapiens
ttttgttcgttcggctcgcgtga

SEQ ID NO: 39673 - DNA, 21 bp, Homo sapiens
tttgttcgttcggctcgcgtg

SEQ ID NO: 39674 - DNA, 20 bp, Homo sapiens
tttgttcgttcggctcgcgt

SEQ ID NO: 39675 - DNA, 19 bp, Homo sapiens
tttgttcgttcggctcgcg

SEQ ID NO: 39676 - DNA, 18 bp, Homo sapiens
tttgttcgttcggctcgc

SEQ ID NO: 39677 - DNA, 16 bp, Homo sapiens
tttgttcgttcggctc

SEQ ID NO: 39678 - DNA, 26 bp, Homo sapiens
tcgaggactggtggaagggcctttcc

SEQ ID NO: 39679 - DNA, 25 bp, Homo sapiens
tcgaggactggtggaagggcctttc

SEQ ID NO: 39680 - DNA, 23 bp, Homo sapiens
cgaggactggtggaagggccttt

SEQ ID NO: 39681 - DNA, 24 bp, Homo sapiens
tcgaggactggtggaagggccttt

SEQ ID NO: 39682 - DNA, 21 bp, Homo sapiens
gaggactggtggaagggcctt

SEQ ID NO: 39683 - DNA, 22 bp, Homo sapiens
cgaggactggtggaagggcctt

SEQ ID NO: 39684 - DNA, 22 bp, Homo sapiens
tcgaggactggtggaagggcct

SEQ ID NO: 39685 - DNA, 21 bp, Homo sapiens
tcgaggactggtggaagggcc

SEQ ID NO: 39686 - DNA, 20 bp, Homo sapiens
tcgaggactggtggaagggc

SEQ ID NO: 39687 - DNA, 19 bp, Homo sapiens
tcgaggactggtggaaggg

SEQ ID NO: 39688 - DNA, 22 bp, Homo sapiens
tgaaggacaaggtgtgcatgcc

SEQ ID NO: 39689 - DNA, 22 bp, Homo sapiens
gacaaggtgtgcatgcctgacc

SEQ ID NO: 39690 - DNA, 23 bp, Homo sapiens
gacaaggtgtgcatgcctgaccc

SEQ ID NO: 39691 - DNA, 24 bp, Homo sapiens
gacaaggtgtgcatgcctgacccg

SEQ ID NO: 39692 - DNA, 19 bp, Homo sapiens
acaaggtgtgcatgcctga

SEQ ID NO: 39693 - DNA, 20 bp, Homo sapiens
acaaggtgtgcatgcctgac

SEQ ID NO: 39694 - DNA, 22 bp, Homo sapiens
acaaggtgtgcatgcctgaccc

SEQ ID NO: 39695 - DNA, 23 bp, Homo sapiens
acaaggtgtgcatgcctgacccg

SEQ ID NO: 39696 - DNA, 24 bp, Homo sapiens
acaaggtgtgcatgcctgacccgt

SEQ ID NO: 39697 - DNA, 27 bp, Homo sapiens
acaaggtgtgcatgcctgacccgttgt

SEQ ID NO: 39698 - DNA, 26 bp, Homo sapiens
ggcagggagggcatgcgcactttgtc

SEQ ID NO: 39699 - DNA, 24 bp, Homo sapiens
gcagggagggcatgcgcactttgt

SEQ ID NO: 39700 - DNA, 21 bp, Homo sapiens
ggagggcatgcgcactttgtc

SEQ ID NO: 39701 - DNA, 18 bp, Homo sapiens
gagggcatgcgcactttg

SEQ ID NO: 39702 - DNA, 19 bp, Homo sapiens
gagggcatgcgcactttgt

SEQ ID NO: 39703 - DNA, 20 bp, Homo sapiens
gagggcatgcgcactttgtc

SEQ ID NO: 39704 - DNA, 23 bp, Homo sapiens
gagggcatgcgcactttgtcctc

SEQ ID NO: 39705 - DNA, 19 bp, Homo sapiens
tggagagaaaggcagttcc

SEQ ID NO: 39706 - DNA, 20 bp, Homo sapiens
tggagagaaaggcagttcct

SEQ ID NO: 39707 - DNA, 21 bp, Homo sapiens
tggagagaaaggcagttcctg

SEQ ID NO: 39708 - DNA, 23 bp, Homo sapiens
tggagagaaaggcagttcctgat

SEQ ID NO: 39709 - DNA, 24 bp, Homo sapiens
tggagagaaaggcagttcctgatg

SEQ ID NO: 39710 - DNA, 20 bp, Homo sapiens
caggggctggctttcctctg

SEQ ID NO: 39711 - DNA, 22 bp, Homo sapiens
caggggctggctttcctctggt

SEQ ID NO: 39712 - DNA, 23 bp, Homo sapiens
caggggctggctttcctctggtc

SEQ ID NO: 39713 - DNA, 24 bp, Homo sapiens
caggggctggctttcctctggtcc

SEQ ID NO: 39714 - DNA, 17 bp, Homo sapiens
aggggctggctttcctc

SEQ ID NO: 39715 - DNA, 18 bp, Homo sapiens
aggggctggctttcctct

SEQ ID NO: 39716 - DNA, 20 bp, Homo sapiens
aggggctggctttcctctgg

SEQ ID NO: 39717 - DNA, 21 bp, Homo sapiens
aggggctggctttcctctggt

SEQ ID NO: 39718 - DNA, 23 bp, Homo sapiens
aggggctggctttcctctggtcc

SEQ ID NO: 39719 - DNA, 24 bp, Homo sapiens
aggggctggctttcctctggtcct

SEQ ID NO: 39720 - DNA, 25 bp, Homo sapiens
aggggctggctttcctctggtcctt

SEQ ID NO: 39721 - DNA, 26 bp, Homo sapiens
aggggctggctttcctctggtccttc

SEQ ID NO: 39722 - DNA, 27 bp, Homo sapiens
aggggctggctttcctctggtccttcc

SEQ ID NO: 39723 - DNA, 18 bp, Homo sapiens
aaaagctgtctacattaa

SEQ ID NO: 39724 - DNA, 26 bp, Homo sapiens
agctgtctacattaatgaaaagagca

SEQ ID NO: 39725 - DNA, 25 bp, Homo sapiens
gctgtctacattaatgaaaagagca

SEQ ID NO: 39726 - DNA, 24 bp, Homo sapiens
ctgtctacattaatgaaaagagca

SEQ ID NO: 39727 - DNA, 23 bp, Homo sapiens
tgtctacattaatgaaaagagca

SEQ ID NO: 39728 - DNA, 24 bp, Homo sapiens
tgtctacattaatgaaaagagcaa

SEQ ID NO: 39729 - DNA, 22 bp, Homo sapiens
gtctacattaatgaaaagagca

SEQ ID NO: 39730 - DNA, 25 bp, Homo sapiens
gtctacattaatgaaaagagcaatg

SEQ ID NO: 39731 - DNA, 20 bp, Homo sapiens
tctacattaatgaaaagagc

SEQ ID NO: 39732 - DNA, 21 bp, Homo sapiens
tctacattaatgaaaagagca

SEQ ID NO: 39733 - DNA, 23 bp, Homo sapiens
tctacattaatgaaaagagcaat

SEQ ID NO: 39734 - DNA, 20 bp, Homo sapiens
ctacattaatgaaaagagca

SEQ ID NO: 39735 - DNA, 22 bp, Homo sapiens
ctacattaatgaaaagagcaat

SEQ ID NO: 39736 - DNA, 18 bp, Homo sapiens
tacattaatgaaaagagc

SEQ ID NO: 39737 - DNA, 18 bp, Homo sapiens
ccacctcccctgcaaacg

SEQ ID NO: 39738 - DNA, 19 bp, Homo sapiens
ccacctcccctgcaaacgt

SEQ ID NO: 39739 - DNA, 20 bp, Homo sapiens
ccacctcccctgcaaacgtc

SEQ ID NO: 39740 - DNA, 21 bp, Homo sapiens
ccacctcccctgcaaacgtcc

SEQ ID NO: 39741 - DNA, 23 bp, Homo sapiens
ccacctcccctgcaaacgtccag

SEQ ID NO: 39742 - DNA, 24 bp, Homo sapiens
ccacctcccctgcaaacgtccagt

SEQ ID NO: 39743 - DNA, 19 bp, Homo sapiens
cctgcaaacgtccagtggt

SEQ ID NO: 39744 - DNA, 20 bp, Homo sapiens
cctgcaaacgtccagtggtg

SEQ ID NO: 39745 - DNA, 16 bp, Homo sapiens
taatggacgttggctc

SEQ ID NO: 39746 - DNA, 19 bp, Homo sapiens
gacgttggctctggtggtg

SEQ ID NO: 39747 - DNA, 20 bp, Homo sapiens
gacgttggctctggtggtga

SEQ ID NO: 39748 - DNA, 21 bp, Homo sapiens
gacgttggctctggtggtgat

SEQ ID NO: 39749 - DNA, 22 bp, Homo sapiens
gacgttggctctggtggtgatg

SEQ ID NO: 39750 - DNA, 23 bp, Homo sapiens
gacgttggctctggtggtgatgg

SEQ ID NO: 39751 - DNA, 17 bp, Homo sapiens
acgttggctctggtggt

SEQ ID NO: 39752 - DNA, 20 bp, Homo sapiens
acgttggctctggtggtgat

SEQ ID NO: 39753 - DNA, 21 bp, Homo sapiens
acgttggctctggtggtgatg

SEQ ID NO: 39754 - DNA, 22 bp, Homo sapiens
acgttggctctggtggtgatgg

SEQ ID NO: 39755 - DNA, 24 bp, Homo sapiens
acgttggctctggtggtgatggac

SEQ ID NO: 39756 - DNA, 21 bp, Homo sapiens
ggacctgcaccttcgcccaca

SEQ ID NO: 39757 - DNA, 22 bp, Homo sapiens
aggacctgcaccttcgcccaca

SEQ ID NO: 39758 - DNA, 23 bp, Homo sapiens
aaggacctgcaccttcgcccaca

SEQ ID NO: 39759 - DNA, 24 bp, Homo sapiens
gaaggacctgcaccttcgcccaca

SEQ ID NO: 39760 - DNA, 22 bp, Homo sapiens
aaggacctgcaccttcgcccac

SEQ ID NO: 39761 - DNA, 21 bp, Homo sapiens
aaggacctgcaccttcgccca

SEQ ID NO: 39762 - DNA, 22 bp, Homo sapiens
gaaggacctgcaccttcgccca

SEQ ID NO: 39763 - DNA, 20 bp, Homo sapiens
aaggacctgcaccttcgccc

SEQ ID NO: 39764 - DNA, 19 bp, Homo sapiens
aaggacctgcaccttcgcc

SEQ ID NO: 39765 - DNA, 17 bp, Homo sapiens
gacactgaaggacctgc

SEQ ID NO: 39766 - DNA, 22 bp, Homo sapiens
cggggcaggtccctgcagggac

SEQ ID NO: 39767 - DNA, 24 bp, Homo sapiens
ggggcggggcaggtccctgcaggg

SEQ ID NO: 39768 - DNA, 24 bp, Homo sapiens
tggggcggggcaggtccctgcagg

SEQ ID NO: 39769 - DNA, 22 bp, Homo sapiens
ggggcggggcaggtccctgcag

SEQ ID NO: 39770 - DNA, 25 bp, Homo sapiens
agtggggcggggcaggtccctgcag

SEQ ID NO: 39771 - DNA, 21 bp, Homo sapiens
ggggcggggcaggtccctgca

SEQ ID NO: 39772 - DNA, 22 bp, Homo sapiens
tggggcggggcaggtccctgca

SEQ ID NO: 39773 - DNA, 18 bp, Homo sapiens
agtggggcggggcaggtc

SEQ ID NO: 39774 - DNA, 17 bp, Homo sapiens
agtggggcggggcaggt

SEQ ID NO: 39775 - DNA, 18 bp, Homo sapiens
acaaaagtgatcattggc

SEQ ID NO: 39776 - DNA, 28 bp, Homo sapiens
ttgcatagtcacaaaagtgatcattggc

SEQ ID NO: 39777 - DNA, 16 bp, Homo sapiens
ctccagttgcatagtc

SEQ ID NO: 39778 - DNA, 25 bp, Homo sapiens
tgcaggaccaagatgagcccttggt

SEQ ID NO: 39779 - DNA, 23 bp, Homo sapiens
gcaggaccaagatgagcccttgg

SEQ ID NO: 39780 - DNA, 24 bp, Homo sapiens
tgcaggaccaagatgagcccttgg

SEQ ID NO: 39781 - DNA, 23 bp, Homo sapiens
tgcaggaccaagatgagcccttg

SEQ ID NO: 39782 - DNA, 22 bp, Homo sapiens
tgcaggaccaagatgagccctt

SEQ ID NO: 39783 - DNA, 20 bp, Homo sapiens
tgcaggaccaagatgagccc

SEQ ID NO: 39784 - DNA, 19 bp, Homo sapiens
tgcaggaccaagatgagcc

SEQ ID NO: 39785 - DNA, 18 bp, Homo sapiens
tgcaggaccaagatgagc

SEQ ID NO: 39786 - DNA, 17 bp, Homo sapiens
tgcaggaccaagatgag

SEQ ID NO: 39787 - DNA, 22 bp, Homo sapiens
atgggtagagaaggagctcaga

SEQ ID NO: 39788 - DNA, 24 bp, Homo sapiens
cggctcctcctctcaggatgtgat

SEQ ID NO: 39789 - DNA, 23 bp, Homo sapiens
cggctcctcctctcaggatgtga

SEQ ID NO: 39790 - DNA, 17 bp, Homo sapiens
cagtgcaatgatattgt

SEQ ID NO: 39791 - DNA, 18 bp, Homo sapiens
cagtgcaatgatattgtc

SEQ ID NO: 39792 - DNA, 19 bp, Homo sapiens
cagtgcaatgatattgtca

SEQ ID NO: 39793 - DNA, 20 bp, Homo sapiens
cagtgcaatgatattgtcaa

SEQ ID NO: 39794 - DNA, 21 bp, Homo sapiens
cagtgcaatgatattgtcaaa

SEQ ID NO: 39795 - DNA, 22 bp, Homo sapiens
cagtgcaatgatattgtcaaag

SEQ ID NO: 39796 - DNA, 24 bp, Homo sapiens
cagtgcaatgatattgtcaaagca

SEQ ID NO: 39797 - DNA, 25 bp, Homo sapiens
cagtgcaatgatattgtcaaagcat

SEQ ID NO: 39798 - DNA, 26 bp, Homo sapiens
cagtgcaatgatattgtcaaagcatc

SEQ ID NO: 39799 - DNA, 27 bp, Homo sapiens
cagtgcaatgatattgtcaaagcatct

SEQ ID NO: 39800 - DNA, 21 bp, Homo sapiens
agtgcaatgatattgtcaaag

SEQ ID NO: 39801 - DNA, 22 bp, Homo sapiens
agtgcaatgatattgtcaaagc

SEQ ID NO: 39802 - DNA, 25 bp, Homo sapiens
agtgcaatgatattgtcaaagcatc

SEQ ID NO: 39803 - DNA, 23 bp, Homo sapiens
tgcaatgatattgtcaaagcatc

SEQ ID NO: 39804 - DNA, 27 bp, Homo sapiens
cccgacactctttccctgttgcactac

SEQ ID NO: 39805 - DNA, 24 bp, Homo sapiens
cgacactctttccctgttgcacta

SEQ ID NO: 39806 - DNA, 22 bp, Homo sapiens
acactctttccctgttgcacta

SEQ ID NO: 39807 - DNA, 22 bp, Homo sapiens
actctttccctgttgcactact

SEQ ID NO: 39808 - DNA, 23 bp, Homo sapiens
actctttccctgttgcactacta

SEQ ID NO: 39809 - DNA, 24 bp, Homo sapiens
actctttccctgttgcactactat

SEQ ID NO: 39810 - DNA, 25 bp, Homo sapiens
actctttccctgttgcactactata

SEQ ID NO: 39811 - DNA, 26 bp, Homo sapiens
actctttccctgttgcactactatag

SEQ ID NO: 39812 - DNA, 27 bp, Homo sapiens
actctttccctgttgcactactatagg

SEQ ID NO: 39813 - DNA, 20 bp, Homo sapiens
ctctttccctgttgcactac

SEQ ID NO: 39814 - DNA, 21 bp, Homo sapiens
ctctttccctgttgcactact

SEQ ID NO: 39815 - DNA, 24 bp, Homo sapiens
ctctttccctgttgcactactata

SEQ ID NO: 39816 - DNA, 20 bp, Homo sapiens
tctttccctgttgcactact

SEQ ID NO: 39817 - DNA, 22 bp, Homo sapiens
tctttccctgttgcactactat

SEQ ID NO: 39818 - DNA, 19 bp, Homo sapiens
ctttccctgttgcactact

SEQ ID NO: 39819 - DNA, 23 bp, Homo sapiens
ctttccctgttgcactactatag

SEQ ID NO: 39820 - DNA, 24 bp, Homo sapiens
ctttccctgttgcactactatagg

SEQ ID NO: 39821 - DNA, 18 bp, Homo sapiens
cagtgcaatgatgaaagg

SEQ ID NO: 39822 - DNA, 19 bp, Homo sapiens
cagtgcaatgatgaaaggg

SEQ ID NO: 39823 - DNA, 20 bp, Homo sapiens
cagtgcaatgatgaaagggc

SEQ ID NO: 39824 - DNA, 21 bp, Homo sapiens
cagtgcaatgatgaaagggca

SEQ ID NO: 39825 - DNA, 23 bp, Homo sapiens
cagtgcaatgatgaaagggcatc

SEQ ID NO: 39826 - DNA, 24 bp, Homo sapiens
cagtgcaatgatgaaagggcatcg

SEQ ID NO: 39827 - DNA, 26 bp, Homo sapiens
cagtgcaatgatgaaagggcatcggt

SEQ ID NO: 39828 - DNA, 21 bp, Homo sapiens
agtgcaatgatgaaagggcat

SEQ ID NO: 39829 - DNA, 24 bp, Homo sapiens
tcaggaggcagcgctctcaggacg

SEQ ID NO: 39830 - DNA, 26 bp, Homo sapiens
caggaggcagcgctctcaggacgtca

SEQ ID NO: 39831 - DNA, 28 bp, Homo sapiens
caggaggcagcgctctcaggacgtcacc

SEQ ID NO: 39832 - DNA, 25 bp, Homo sapiens
gaggcagcgctctcaggacgtcacc

SEQ ID NO: 39833 - DNA, 19 bp, Homo sapiens
aggcagcgctctcaggacg

SEQ ID NO: 39834 - DNA, 18 bp, Homo sapiens
ggcagcgctctcaggacg

SEQ ID NO: 39835 - DNA, 18 bp, Homo sapiens
gcagcgctctcaggacgt

SEQ ID NO: 39836 - DNA, 19 bp, Homo sapiens
gcagcgctctcaggacgtc

SEQ ID NO: 39837 - DNA, 19 bp, Homo sapiens
gcgctctcaggacgtcacc

SEQ ID NO: 39838 - DNA, 18 bp, Homo sapiens
cgctctcaggacgtcacc

SEQ ID NO: 39839 - DNA, 20 bp, Homo sapiens
caagcaattctcaaaggagc

SEQ ID NO: 39840 - DNA, 21 bp, Homo sapiens
caagcaattctcaaaggagcc

SEQ ID NO: 39841 - DNA, 18 bp, Homo sapiens
aagcaattctcaaaggag

SEQ ID NO: 39842 - DNA, 19 bp, Homo sapiens
aagcaattctcaaaggagc

SEQ ID NO: 39843 - DNA, 20 bp, Homo sapiens
aagcaattctcaaaggagcc

SEQ ID NO: 39844 - DNA, 21 bp, Homo sapiens
aagcaattctcaaaggagcct

SEQ ID NO: 39845 - DNA, 23 bp, Homo sapiens
aagcaattctcaaaggagcctcc

SEQ ID NO: 39846 - DNA, 20 bp, Homo sapiens
agcaattctcaaaggagcct

SEQ ID NO: 39847 - DNA, 22 bp, Homo sapiens
agcaattctcaaaggagcctcc

SEQ ID NO: 39848 - DNA, 22 bp, Homo sapiens
gcaattctcaaaggagcctccc

SEQ ID NO: 39849 - DNA, 23 bp, Homo sapiens
gcaattctcaaaggagcctccca

SEQ ID NO: 39850 - DNA, 24 bp, Homo sapiens
attctcaaaggagcctcccaggaa

SEQ ID NO: 39851 - DNA, 22 bp, Homo sapiens
tctcaaaggagcctcccaggaa

SEQ ID NO: 39852 - DNA, 21 bp, Homo sapiens
gaagtcctaggaggctcctct

SEQ ID NO: 39853 - DNA, 22 bp, Homo sapiens
aagtcctaggaggctcctctga

SEQ ID NO: 39854 - DNA, 21 bp, Homo sapiens
gtcctaggaggctcctctgag

SEQ ID NO: 39855 - DNA, 19 bp, Homo sapiens
tcctaggaggctcctctga

SEQ ID NO: 39856 - DNA, 23 bp, Homo sapiens
tcctaggaggctcctctgagagt

SEQ ID NO: 39857 - DNA, 22 bp, Homo sapiens
ctaggaggctcctctgagagtt

SEQ ID NO: 39858 - DNA, 18 bp, Homo sapiens
taggaggctcctctgaga

SEQ ID NO: 39859 - DNA, 19 bp, Homo sapiens
taggaggctcctctgagag

SEQ ID NO: 39860 - DNA, 20 bp, Homo sapiens
taggaggctcctctgagagt

SEQ ID NO: 39861 - DNA, 21 bp, Homo sapiens
taggaggctcctctgagagtt

SEQ ID NO: 39862 - DNA, 20 bp, Homo sapiens
aggaggctcctctgagagtt

SEQ ID NO: 39863 - DNA, 19 bp, Homo sapiens
ggaggctcctctgagagtt

SEQ ID NO: 39864 - DNA, 18 bp, Homo sapiens
gaggctcctctgagagtt

SEQ ID NO: 39865 - DNA, 17 bp, Homo sapiens
aggctcctctgagagtt

SEQ ID NO: 39866 - DNA, 21 bp, Homo sapiens
tttctctctgactccatggca

SEQ ID NO: 39867 - DNA, 22 bp, Homo sapiens
ttctctctgactccatggcagc

SEQ ID NO: 39868 - DNA, 20 bp, Homo sapiens
tctctctgactccatggcag

SEQ ID NO: 39869 - DNA, 21 bp, Homo sapiens
tctctctgactccatggcagc

SEQ ID NO: 39870 - DNA, 22 bp, Homo sapiens
tctctctgactccatggcagct

SEQ ID NO: 39871 - DNA, 26 bp, Homo sapiens
gactgataccttggaggcattttatc

SEQ ID NO: 39872 - DNA, 26 bp, Homo sapiens
agtgactgataccttggaggcatttt

SEQ ID NO: 39873 - DNA, 22 bp, Homo sapiens
gactgataccttggaggcattt

SEQ ID NO: 39874 - DNA, 20 bp, Homo sapiens
actgataccttggaggcatt

SEQ ID NO: 39875 - DNA, 21 bp, Homo sapiens
gactgataccttggaggcatt

SEQ ID NO: 39876 - DNA, 22 bp, Homo sapiens
tgactgataccttggaggcatt

SEQ ID NO: 39877 - DNA, 23 bp, Homo sapiens
gtgactgataccttggaggcatt

SEQ ID NO: 39878 - DNA, 18 bp, Homo sapiens
cattacttttgcaccagc

SEQ ID NO: 39879 - DNA, 26 bp, Homo sapiens
aaaaactgcattacttttgcaccagc

SEQ ID NO: 39880 - DNA, 27 bp, Homo sapiens
caaaaactgcattacttttgcaccagc

SEQ ID NO: 39881 - DNA, 27 bp, Homo sapiens
caaaagtaattgcggtctttggtatta

SEQ ID NO: 39882 - DNA, 25 bp, Homo sapiens
aaaagtaattgcggtctttggtatt

SEQ ID NO: 39883 - DNA, 26 bp, Homo sapiens
caaaagtaattgcggtctttggtatt

SEQ ID NO: 39884 - DNA, 27 bp, Homo sapiens
gcaaaagtaattgcggtctttggtatt

SEQ ID NO: 39885 - DNA, 24 bp, Homo sapiens
aaaagtaattgcggtctttggtat

SEQ ID NO: 39886 - DNA, 23 bp, Homo sapiens
aaaagtaattgcggtctttggta

SEQ ID NO: 39887 - DNA, 24 bp, Homo sapiens
caaaagtaattgcggtctttggta

SEQ ID NO: 39888 - DNA, 23 bp, Homo sapiens
caaaagtaattgcggtctttggt

SEQ ID NO: 39889 - DNA, 21 bp, Homo sapiens
aaaagtaattgcggtctttgg

SEQ ID NO: 39890 - DNA, 22 bp, Homo sapiens
caaaagtaattgcggtctttgg

SEQ ID NO: 39891 - DNA, 24 bp, Homo sapiens
agtcagcaacatatcccatgactt

SEQ ID NO: 39892 - DNA, 23 bp, Homo sapiens
agtcagcaacatatcccatgact

SEQ ID NO: 39893 - DNA, 24 bp, Homo sapiens
tgagtcagcaacatatcccatgac

SEQ ID NO: 39894 - DNA, 21 bp, Homo sapiens
agtcagcaacatatcccatga

SEQ ID NO: 39895 - DNA, 23 bp, Homo sapiens
tgagtcagcaacatatcccatga

SEQ ID NO: 39896 - DNA, 21 bp, Homo sapiens
tgagtcagcaacatatcccat

SEQ ID NO: 39897 - DNA, 20 bp, Homo sapiens
tgagtcagcaacatatccca

SEQ ID NO: 39898 - DNA, 21 bp, Homo sapiens
ttgagtcagcaacatatccca

SEQ ID NO: 39899 - DNA, 16 bp, Homo sapiens
actcccagggactgcc

SEQ ID NO: 39900 - DNA, 17 bp, Homo sapiens
actcccagggactgcct

SEQ ID NO: 39901 - DNA, 18 bp, Homo sapiens
actcccagggactgcctt

SEQ ID NO: 39902 - DNA, 20 bp, Homo sapiens
actcccagggactgccttag

SEQ ID NO: 39903 - DNA, 21 bp, Homo sapiens
actcccagggactgccttagg

SEQ ID NO: 39904 - DNA, 22 bp, Homo sapiens
actcccagggactgccttagga

SEQ ID NO: 39905 - DNA, 23 bp, Homo sapiens
actcccagggactgccttaggag

SEQ ID NO: 39906 - DNA, 21 bp, Homo sapiens
tcccagggactgccttaggag

SEQ ID NO: 39907 - DNA, 22 bp, Homo sapiens
tcccagggactgccttaggaga

SEQ ID NO: 39908 - DNA, 23 bp, Homo sapiens
tcccagggactgccttaggagaa

SEQ ID NO: 39909 - DNA, 24 bp, Homo sapiens
tcccagggactgccttaggagaaa

SEQ ID NO: 39910 - DNA, 21 bp, Homo sapiens
cccagggactgccttaggaga

SEQ ID NO: 39911 - DNA, 22 bp, Homo sapiens
cccagggactgccttaggagaa

SEQ ID NO: 39912 - DNA, 23 bp, Homo sapiens
tgccttaggagaaagtttctgga

SEQ ID NO: 39913 - DNA, 21 bp, Homo sapiens
ccttaggagaaagtttctgga

SEQ ID NO: 39914 - DNA, 20 bp, Homo sapiens
cttaggagaaagtttctgga

SEQ ID NO: 39915 - DNA, 19 bp, Homo sapiens
ttaggagaaagtttctgga

SEQ ID NO: 39916 - DNA, 18 bp, Homo sapiens
taggagaaagtttctgga

SEQ ID NO: 39917 - DNA, 17 bp, Homo sapiens
aggagaaagtttctgga

SEQ ID NO: 39918 - DNA, 18 bp, Homo sapiens
taggagaaagtttctgga

SEQ ID NO: 39919 - DNA, 19 bp, Homo sapiens
ttaggagaaagtttctgga

SEQ ID NO: 39920 - DNA, 20 bp, Homo sapiens
cttaggagaaagtttctgga

SEQ ID NO: 39921 - DNA, 18 bp, Homo sapiens
ccctcaggagaagtcggg

SEQ ID NO: 39922 - DNA, 21 bp, Homo sapiens
cctcaggagaagtcgggaagg

SEQ ID NO: 39923 - DNA, 20 bp, Homo sapiens
ctcaggagaagtcgggaagg

SEQ ID NO: 39924 - DNA, 21 bp, Homo sapiens
ctcaggagaagtcgggaaggt

SEQ ID NO: 39925 - DNA, 22 bp, Homo sapiens
ctcaggagaagtcgggaaggtg

SEQ ID NO: 39926 - DNA, 20 bp, Homo sapiens
tcaggagaagtcgggaaggt

SEQ ID NO: 39927 - DNA, 21 bp, Homo sapiens
tcaggagaagtcgggaaggtg

SEQ ID NO: 39928 - DNA, 22 bp, Homo sapiens
tcaggagaagtcgggaaggtgg

SEQ ID NO: 39929 - DNA, 19 bp, Homo sapiens
caggagaagtcgggaaggt

SEQ ID NO: 39930 - DNA, 21 bp, Homo sapiens
caggagaagtcgggaaggtgg

SEQ ID NO: 39931 - DNA, 25 bp, Homo sapiens
caggagaagtcgggaaggtggcggc

SEQ ID NO: 39932 - DNA, 20 bp, Homo sapiens
aggagaagtcgggaaggtgg

SEQ ID NO: 39933 - DNA, 22 bp, Homo sapiens
aggagaagtcgggaaggtggcg

SEQ ID NO: 39934 - DNA, 24 bp, Homo sapiens
aggagaagtcgggaaggtggcggc

SEQ ID NO: 39935 - DNA, 18 bp, Homo sapiens
ggagaagtcgggaaggtg

SEQ ID NO: 39936 - DNA, 19 bp, Homo sapiens
ggagaagtcgggaaggtgg

SEQ ID NO: 39937 - DNA, 23 bp, Homo sapiens
ggagaagtcgggaaggtggcggc

SEQ ID NO: 39938 - DNA, 17 bp, Homo sapiens
agaagtcgggaaggtgg

SEQ ID NO: 39939 - DNA, 19 bp, Homo sapiens
aagtcgggaaggtggcggc

SEQ ID NO: 39940 - DNA, 18 bp, Homo sapiens
agtcgggaaggtggcggc

SEQ ID NO: 39941 - DNA, 16 bp, Homo sapiens
tcgggaaggtggcggc

SEQ ID NO: 39942 - DNA, 17 bp, Homo sapiens
tgtcctgcggagagaga

SEQ ID NO: 39943 - DNA, 19 bp, Homo sapiens
aagttgactgaaggggctg

SEQ ID NO: 39944 - DNA, 20 bp, Homo sapiens
agaagttgactgaaggggct

SEQ ID NO: 39945 - DNA, 23 bp, Homo sapiens
ctaagaagttgactgaaggggct

SEQ ID NO: 39946 - DNA, 16 bp, Homo sapiens
aagttgactgaagggg

SEQ ID NO: 39947 - DNA, 25 bp, Homo sapiens
gcctctaagaagttgactgaagggg

SEQ ID NO: 39948 - DNA, 18 bp, Homo sapiens
aagaagttgactgaaggg

SEQ ID NO: 39949 - DNA, 21 bp, Homo sapiens
tctaagaagttgactgaaggg

SEQ ID NO: 39950 - DNA, 22 bp, Homo sapiens
ctctaagaagttgactgaaggg

SEQ ID NO: 39951 - DNA, 23 bp, Homo sapiens
cctctaagaagttgactgaaggg

SEQ ID NO: 39952 - DNA, 24 bp, Homo sapiens
gcctctaagaagttgactgaaggg

SEQ ID NO: 39953 - DNA, 25 bp, Homo sapiens
agcctctaagaagttgactgaaggg

SEQ ID NO: 39954 - DNA, 26 bp, Homo sapiens
gagcctctaagaagttgactgaaggg

SEQ ID NO: 39955 - DNA, 19 bp, Homo sapiens
ctaagaagttgactgaagg

SEQ ID NO: 39956 - DNA, 21 bp, Homo sapiens
ctctaagaagttgactgaagg

SEQ ID NO: 39957 - DNA, 23 bp, Homo sapiens
gcctctaagaagttgactgaagg

SEQ ID NO: 39958 - DNA, 24 bp, Homo sapiens
agcctctaagaagttgactgaagg

SEQ ID NO: 39959 - DNA, 25 bp, Homo sapiens
gagcctctaagaagttgactgaagg

SEQ ID NO: 39960 - DNA, 20 bp, Homo sapiens
ctctaagaagttgactgaag

SEQ ID NO: 39961 - DNA, 21 bp, Homo sapiens
cctctaagaagttgactgaag

SEQ ID NO: 39962 - DNA, 22 bp, Homo sapiens
gcctctaagaagttgactgaag

SEQ ID NO: 39963 - DNA, 23 bp, Homo sapiens
agcctctaagaagttgactgaag

SEQ ID NO: 39964 - DNA, 24 bp, Homo sapiens
gagcctctaagaagttgactgaag

SEQ ID NO: 39965 - DNA, 23 bp, Homo sapiens
gagcctctaagaagttgactgaa

SEQ ID NO: 39966 - DNA, 22 bp, Homo sapiens
gagcctctaagaagttgactga

SEQ ID NO: 39967 - DNA, 21 bp, Homo sapiens
gagcctctaagaagttgactg

SEQ ID NO: 39968 - DNA, 18 bp, Homo sapiens
agcctctaagaagttgac

SEQ ID NO: 39969 - DNA, 19 bp, Homo sapiens
gagcctctaagaagttgac

SEQ ID NO: 39970 - DNA, 17 bp, Homo sapiens
gagcctctaagaagttg

SEQ ID NO: 39971 - DNA, 25 bp, Homo sapiens
attttgtgtgagtacagagagcatc

SEQ ID NO: 39972 - DNA, 24 bp, Homo sapiens
ttttgtgtgagtacagagagcatc

SEQ ID NO: 39973 - DNA, 21 bp, Homo sapiens
tttgtgtgagtacagagagca

SEQ ID NO: 39974 - DNA, 22 bp, Homo sapiens
tttgtgtgagtacagagagcat

SEQ ID NO: 39975 - DNA, 23 bp, Homo sapiens
tttgtgtgagtacagagagcatc

SEQ ID NO: 39976 - DNA, 24 bp, Homo sapiens
tttgtgtgagtacagagagcatct

SEQ ID NO: 39977 - DNA, 25 bp, Homo sapiens
tttgtgtgagtacagagagcatctg

SEQ ID NO: 39978 - DNA, 18 bp, Homo sapiens
ttgtgtgagtacagagag

SEQ ID NO: 39979 - DNA, 19 bp, Homo sapiens
ttgtgtgagtacagagagc

SEQ ID NO: 39980 - DNA, 20 bp, Homo sapiens
ttgtgtgagtacagagagca

SEQ ID NO: 39981 - DNA, 21 bp, Homo sapiens
ttgtgtgagtacagagagcat

SEQ ID NO: 39982 - DNA, 23 bp, Homo sapiens
ttgtgtgagtacagagagcatct

SEQ ID NO: 39983 - DNA, 24 bp, Homo sapiens
ttgtgtgagtacagagagcatctg

SEQ ID NO: 39984 - DNA, 20 bp, Homo sapiens
tgtgtgagtacagagagcat

SEQ ID NO: 39985 - DNA, 21 bp, Homo sapiens
tgtgtgagtacagagagcatc

SEQ ID NO: 39986 - DNA, 22 bp, Homo sapiens
tgtgtgagtacagagagcatct

SEQ ID NO: 39987 - DNA, 22 bp, Homo sapiens
tgtgagtacagagagcatctga

SEQ ID NO: 39988 - DNA, 25 bp, Homo sapiens
tgtgagtacagagagcatctgaatg

SEQ ID NO: 39989 - DNA, 19 bp, Homo sapiens
tacagagagcatctgaatg

SEQ ID NO: 39990 - DNA, 25 bp, Homo sapiens
cagttgttgtctcttgttcctcaca

SEQ ID NO: 39991 - DNA, 24 bp, Homo sapiens
gttgttgtctcttgttcctcacac

SEQ ID NO: 39992 - DNA, 22 bp, Homo sapiens
ttgttgtctcttgttcctcaca

SEQ ID NO: 39993 - DNA, 23 bp, Homo sapiens
ttgttgtctcttgttcctcacac

SEQ ID NO: 39994 - DNA, 24 bp, Homo sapiens
ttgttgtctcttgttcctcacaca

SEQ ID NO: 39995 - DNA, 26 bp, Homo sapiens
ttgttgtctcttgttcctcacacagg

SEQ ID NO: 39996 - DNA, 21 bp, Homo sapiens
tgttgtctcttgttcctcaca

SEQ ID NO: 39997 - DNA, 22 bp, Homo sapiens
tgttgtctcttgttcctcacac

SEQ ID NO: 39998 - DNA, 23 bp, Homo sapiens
tgttgtctcttgttcctcacaca

SEQ ID NO: 39999 - DNA, 24 bp, Homo sapiens
tgttgtctcttgttcctcacacag

SEQ ID NO: 40000 - DNA, 25 bp, Homo sapiens
tgttgtctcttgttcctcacacagg

SEQ ID NO: 40001 - DNA, 23 bp, Homo sapiens
gttgtctcttgttcctcacacag

SEQ ID NO: 40002 - DNA, 21 bp, Homo sapiens
ttgtctcttgttcctcacaca

SEQ ID NO: 40003 - DNA, 23 bp, Homo sapiens
ttgtctcttgttcctcacacagg

SEQ ID NO: 40004 - DNA, 24 bp, Homo sapiens
ttgtctcttgttcctcacacaggc

SEQ ID NO: 40005 - DNA, 20 bp, Homo sapiens
tgtctcttgttcctcacaca

SEQ ID NO: 40006 - DNA, 21 bp, Homo sapiens
tgtctcttgttcctcacacag

SEQ ID NO: 40007 - DNA, 22 bp, Homo sapiens
tgtctcttgttcctcacacagg

SEQ ID NO: 40008 - DNA, 23 bp, Homo sapiens
tgtctcttgttcctcacacaggc

SEQ ID NO: 40009 - DNA, 24 bp, Homo sapiens
tgtctcttgttcctcacacaggca

SEQ ID NO: 40010 - DNA, 18 bp, Homo sapiens
gaatctgagaaggcgcac

SEQ ID NO: 40011 - DNA, 22 bp, Homo sapiens
gaatctgagaaggcgcacaagg

SEQ ID NO: 40012 - DNA, 23 bp, Homo sapiens
gaatctgagaaggcgcacaaggt

SEQ ID NO: 40013 - DNA, 24 bp, Homo sapiens
gaatctgagaaggcgcacaaggtt

SEQ ID NO: 40014 - DNA, 25 bp, Homo sapiens
gaatctgagaaggcgcacaaggttt

SEQ ID NO: 40015 - DNA, 16 bp, Homo sapiens
aatctgagaaggcgca

SEQ ID NO: 40016 - DNA, 18 bp, Homo sapiens
aatctgagaaggcgcaca

SEQ ID NO: 40017 - DNA, 20 bp, Homo sapiens
aatctgagaaggcgcacaag

SEQ ID NO: 40018 - DNA, 21 bp, Homo sapiens
aatctgagaaggcgcacaagg

SEQ ID NO: 40019 - DNA, 23 bp, Homo sapiens
aatctgagaaggcgcacaaggtt

SEQ ID NO: 40020 - DNA, 24 bp, Homo sapiens
aatctgagaaggcgcacaaggttt

SEQ ID NO: 40021 - DNA, 25 bp, Homo sapiens
aatctgagaaggcgcacaaggtttg

SEQ ID NO: 40022 - DNA, 26 bp, Homo sapiens
aatctgagaaggcgcacaaggtttgt

SEQ ID NO: 40023 - DNA, 28 bp, Homo sapiens
aatctgagaaggcgcacaaggtttgtgt

SEQ ID NO: 40024 - DNA, 16 bp, Homo sapiens
caccttgcgctactca

SEQ ID NO: 40025 - DNA, 19 bp, Homo sapiens
caccttgcgctactcaggt

SEQ ID NO: 40026 - DNA, 20 bp, Homo sapiens
caccttgcgctactcaggtc

SEQ ID NO: 40027 - DNA, 21 bp, Homo sapiens
caccttgcgctactcaggtct

SEQ ID NO: 40028 - DNA, 23 bp, Homo sapiens
caccttgcgctactcaggtctgc

SEQ ID NO: 40029 - DNA, 24 bp, Homo sapiens
caccttgcgctactcaggtctgct

SEQ ID NO: 40030 - DNA, 25 bp, Homo sapiens
caccttgcgctactcaggtctgctc

SEQ ID NO: 40031 - DNA, 27 bp, Homo sapiens
caccttgcgctactcaggtctgctcgt

SEQ ID NO: 40032 - DNA, 28 bp, Homo sapiens
caccttgcgctactcaggtctgctcgtg

SEQ ID NO: 40033 - DNA, 16 bp, Homo sapiens
accttgcgctactcag

SEQ ID NO: 40034 - DNA, 20 bp, Homo sapiens
accttgcgctactcaggtct

SEQ ID NO: 40035 - DNA, 21 bp, Homo sapiens
ccttgcgctactcaggtctgc

SEQ ID NO: 40036 - DNA, 21 bp, Homo sapiens
ttgcgctactcaggtctgctc

SEQ ID NO: 40037 - DNA, 25 bp, Homo sapiens
aggaaccttggagcttcggcagctt

SEQ ID NO: 40038 - DNA, 23 bp, Homo sapiens
aggaaccttggagcttcggcagc

SEQ ID NO: 40039 - DNA, 24 bp, Homo sapiens
gaggaaccttggagcttcggcagc

SEQ ID NO: 40040 - DNA, 25 bp, Homo sapiens
ggaggaaccttggagcttcggcagc

SEQ ID NO: 40041 - DNA, 22 bp, Homo sapiens
aggaaccttggagcttcggcag

SEQ ID NO: 40042 - DNA, 24 bp, Homo sapiens
ggaggaaccttggagcttcggcag

SEQ ID NO: 40043 - DNA, 21 bp, Homo sapiens
aggaaccttggagcttcggca

SEQ ID NO: 40044 - DNA, 23 bp, Homo sapiens
ggaggaaccttggagcttcggca

SEQ ID NO: 40045 - DNA, 20 bp, Homo sapiens
aggaaccttggagcttcggc

SEQ ID NO: 40046 - DNA, 19 bp, Homo sapiens
aggaaccttggagcttcgg

SEQ ID NO: 40047 - DNA, 21 bp, Homo sapiens
ggaggaaccttggagcttcgg

SEQ ID NO: 40048 - DNA, 20 bp, Homo sapiens
ggaggaaccttggagcttcg

SEQ ID NO: 40049 - DNA, 25 bp, Homo sapiens
gaagctctaaggttccgcctgcggg

SEQ ID NO: 40050 - DNA, 24 bp, Homo sapiens
gaagctctaaggttccgcctgcgg

SEQ ID NO: 40051 - DNA, 23 bp, Homo sapiens
gaagctctaaggttccgcctgcg

SEQ ID NO: 40052 - DNA, 21 bp, Homo sapiens
aagctctaaggttccgcctgc

SEQ ID NO: 40053 - DNA, 22 bp, Homo sapiens
gaagctctaaggttccgcctgc

SEQ ID NO: 40054 - DNA, 21 bp, Homo sapiens
gaagctctaaggttccgcctg

SEQ ID NO: 40055 - DNA, 20 bp, Homo sapiens
gaagctctaaggttccgcct

SEQ ID NO: 40056 - DNA, 22 bp, Homo sapiens
ctgaagctctaaggttccgcct

SEQ ID NO: 40057 - DNA, 19 bp, Homo sapiens
gaagctctaaggttccgcc

SEQ ID NO: 40058 - DNA, 25 bp, Homo sapiens
atggctgaagctctaaggttccgcc

SEQ ID NO: 40059 - DNA, 21 bp, Homo sapiens
gctgaagctctaaggttccgc

SEQ ID NO: 40060 - DNA, 22 bp, Homo sapiens
ggctgaagctctaaggttccgc

SEQ ID NO: 40061 - DNA, 23 bp, Homo sapiens
tggctgaagctctaaggttccgc

SEQ ID NO: 40062 - DNA, 21 bp, Homo sapiens
tggctgaagctctaaggttcc

SEQ ID NO: 40063 - DNA, 22 bp, Homo sapiens
atggctgaagctctaaggttcc

SEQ ID NO: 40064 - DNA, 21 bp, Homo sapiens
atggctgaagctctaaggttc

SEQ ID NO: 40065 - DNA, 20 bp, Homo sapiens
atggctgaagctctaaggtt

SEQ ID NO: 40066 - DNA, 24 bp, Homo sapiens
aagcctctcctgcccttccagatt

SEQ ID NO: 40067 - DNA, 25 bp, Homo sapiens
caagcctctcctgcccttccagatt

SEQ ID NO: 40068 - DNA, 23 bp, Homo sapiens
aagcctctcctgcccttccagat

SEQ ID NO: 40069 - DNA, 24 bp, Homo sapiens
caagcctctcctgcccttccagat

SEQ ID NO: 40070 - DNA, 23 bp, Homo sapiens
caagcctctcctgcccttccaga

SEQ ID NO: 40071 - DNA, 21 bp, Homo sapiens
caagcctctcctgcccttcca

SEQ ID NO: 40072 - DNA, 20 bp, Homo sapiens
caagcctctcctgcccttcc

SEQ ID NO: 40073 - DNA, 19 bp, Homo sapiens
caagcctctcctgcccttc

SEQ ID NO: 40074 - DNA, 17 bp, Homo sapiens
caagcctctcctgccct

SEQ ID NO: 40075 - DNA, 18 bp, Homo sapiens
tggcagcaagcctctcct

SEQ ID NO: 40076 - DNA, 16 bp, Homo sapiens
agaccctgctctccct

SEQ ID NO: 40077 - DNA, 26 bp, Homo sapiens
tcctggggggaggagaccctgctctc

SEQ ID NO: 40078 - DNA, 24 bp, Homo sapiens
cctggggggaggagaccctgctct

SEQ ID NO: 40079 - DNA, 22 bp, Homo sapiens
ctggggggaggagaccctgctc

SEQ ID NO: 40080 - DNA, 23 bp, Homo sapiens
cctggggggaggagaccctgctc

SEQ ID NO: 40081 - DNA, 22 bp, Homo sapiens
cctggggggaggagaccctgct

SEQ ID NO: 40082 - DNA, 23 bp, Homo sapiens
tcctggggggaggagaccctgct

SEQ ID NO: 40083 - DNA, 21 bp, Homo sapiens
cctggggggaggagaccctgc

SEQ ID NO: 40084 - DNA, 22 bp, Homo sapiens
tcctggggggaggagaccctgc

SEQ ID NO: 40085 - DNA, 19 bp, Homo sapiens
ctggggggaggagaccctg

SEQ ID NO: 40086 - DNA, 18 bp, Homo sapiens
ctggggggaggagaccct

SEQ ID NO: 40087 - DNA, 19 bp, Homo sapiens
cctggggggaggagaccct

SEQ ID NO: 40088 - DNA, 20 bp, Homo sapiens
tcctggggggaggagaccct

SEQ ID NO: 40089 - DNA, 21 bp, Homo sapiens
tcggcattctagatgagagat

SEQ ID NO: 40090 - DNA, 22 bp, Homo sapiens
tcggcattctagatgagagata

SEQ ID NO: 40091 - DNA, 21 bp, Homo sapiens
atggtatacctcatctagaat

SEQ ID NO: 40092 - DNA, 23 bp, Homo sapiens
atggtatacctcatctagaatgc

SEQ ID NO: 40093 - DNA, 24 bp, Homo sapiens
atggtatacctcatctagaatgct

SEQ ID NO: 40094 - DNA, 19 bp, Homo sapiens
tatacctcatctagaatgc

SEQ ID NO: 40095 - DNA, 21 bp, Homo sapiens
tatacctcatctagaatgctg

SEQ ID NO: 40096 - DNA, 22 bp, Homo sapiens
tatacctcatctagaatgctgt

SEQ ID NO: 40097 - DNA, 23 bp, Homo sapiens
tatacctcatctagaatgctgta

SEQ ID NO: 40098 - DNA, 20 bp, Homo sapiens
atacctcatctagaatgctg

SEQ ID NO: 40099 - DNA, 21 bp, Homo sapiens
atacctcatctagaatgctgt

SEQ ID NO: 40100 - DNA, 25 bp, Homo sapiens
atacctcatctagaatgctgtaata

SEQ ID NO: 40101 - DNA, 22 bp, Homo sapiens
tacctcatctagaatgctgtaa

SEQ ID NO: 40102 - DNA, 24 bp, Homo sapiens
tacctcatctagaatgctgtaata

SEQ ID NO: 40103 - DNA, 26 bp, Homo sapiens
tacctcatctagaatgctgtaatatt

SEQ ID NO: 40104 - DNA, 18 bp, Homo sapiens
gtccaggtccttgtgacc

SEQ ID NO: 40105 - DNA, 20 bp, Homo sapiens
ctgtccaggtccttgtgacc

SEQ ID NO: 40106 - DNA, 25 bp, Homo sapiens
ttctgcctctgtccaggtccttgtg

SEQ ID NO: 40107 - DNA, 23 bp, Homo sapiens
tctgcctctgtccaggtccttgt

SEQ ID NO: 40108 - DNA, 24 bp, Homo sapiens
ttctgcctctgtccaggtccttgt

SEQ ID NO: 40109 - DNA, 22 bp, Homo sapiens
tctgcctctgtccaggtccttg

SEQ ID NO: 40110 - DNA, 23 bp, Homo sapiens
ttctgcctctgtccaggtccttg

SEQ ID NO: 40111 - DNA, 24 bp, Homo sapiens
gttctgcctctgtccaggtccttg

SEQ ID NO: 40112 - DNA, 21 bp, Homo sapiens
tctgcctctgtccaggtcctt

SEQ ID NO: 40113 - DNA, 21 bp, Homo sapiens
ttctgcctctgtccaggtcct

SEQ ID NO: 40114 - DNA, 20 bp, Homo sapiens
ttctgcctctgtccaggtcc

SEQ ID NO: 40115 - DNA, 21 bp, Homo sapiens
gttctgcctctgtccaggtcc

SEQ ID NO: 40116 - DNA, 19 bp, Homo sapiens
ttctgcctctgtccaggtc

SEQ ID NO: 40117 - DNA, 21 bp, Homo sapiens
agttctgcctctgtccaggtc

SEQ ID NO: 40118 - DNA, 22 bp, Homo sapiens
cagttctgcctctgtccaggtc

SEQ ID NO: 40119 - DNA, 21 bp, Homo sapiens
actcagcggcggagctggctg

SEQ ID NO: 40120 - DNA, 22 bp, Homo sapiens
ggactcagcggcggagctggct

SEQ ID NO: 40121 - DNA, 28 bp, Homo sapiens
agggctggactcagcggcggagctggct

SEQ ID NO: 40122 - DNA, 19 bp, Homo sapiens
gactcagcggcggagctgg

SEQ ID NO: 40123 - DNA, 20 bp, Homo sapiens
ggactcagcggcggagctgg

SEQ ID NO: 40124 - DNA, 26 bp, Homo sapiens
agggctggactcagcggcggagctgg

SEQ ID NO: 40125 - DNA, 25 bp, Homo sapiens
agggctggactcagcggcggagctg

SEQ ID NO: 40126 - DNA, 23 bp, Homo sapiens
agggctggactcagcggcggagc

SEQ ID NO: 40127 - DNA, 17 bp, Homo sapiens
tggactcagcggcggag

SEQ ID NO: 40128 - DNA, 22 bp, Homo sapiens
agggctggactcagcggcggag

SEQ ID NO: 40129 - DNA, 21 bp, Homo sapiens
agggctggactcagcggcgga

SEQ ID NO: 40130 - DNA, 20 bp, Homo sapiens
agggctggactcagcggcgg

SEQ ID NO: 40131 - DNA, 16 bp, Homo sapiens
gctggactcagcggcg

SEQ ID NO: 40132 - DNA, 19 bp, Homo sapiens
agggctggactcagcggcg

SEQ ID NO: 40133 - DNA, 24 bp, Homo sapiens
cgcagagggctggactcagcggcg

SEQ ID NO: 40134 - DNA, 25 bp, Homo sapiens
gcgcagagggctggactcagcggcg

SEQ ID NO: 40135 - DNA, 23 bp, Homo sapiens
gcgcagagggctggactcagcgg

SEQ ID NO: 40136 - DNA, 19 bp, Homo sapiens
gcgcagagggctggactca

SEQ ID NO: 40137 - DNA, 18 bp, Homo sapiens
gcgcagagggctggactc

SEQ ID NO: 40138 - DNA, 17 bp, Homo sapiens
gcgcagagggctggact

SEQ ID NO: 40139 - DNA, 23 bp, Homo sapiens
gttaactcctttcacacccatgg

SEQ ID NO: 40140 - DNA, 22 bp, Homo sapiens
gttaactcctttcacacccatg

SEQ ID NO: 40141 - DNA, 21 bp, Homo sapiens
gttaactcctttcacacccat

SEQ ID NO: 40142 - DNA, 21 bp, Homo sapiens
atgtggaaggagttatctgtc

SEQ ID NO: 40143 - DNA, 24 bp, Homo sapiens
tggatgtggaaggagttatctgtc

SEQ ID NO: 40144 - DNA, 23 bp, Homo sapiens
tggatgtggaaggagttatctgt

SEQ ID NO: 40145 - DNA, 22 bp, Homo sapiens
tggatgtggaaggagttatctg

SEQ ID NO: 40146 - DNA, 21 bp, Homo sapiens
cttgtcctctagggcctgcag

SEQ ID NO: 40147 - DNA, 22 bp, Homo sapiens
cttgtcctctagggcctgcagt

SEQ ID NO: 40148 - DNA, 25 bp, Homo sapiens
cttgtcctctagggcctgcagtctc

SEQ ID NO: 40149 - DNA, 18 bp, Homo sapiens
ttgtcctctagggcctgc

SEQ ID NO: 40150 - DNA, 20 bp, Homo sapiens
ttgtcctctagggcctgcag

SEQ ID NO: 40151 - DNA, 21 bp, Homo sapiens
ttgtcctctagggcctgcagt

SEQ ID NO: 40152 - DNA, 23 bp, Homo sapiens
ttgtcctctagggcctgcagtct

SEQ ID NO: 40153 - DNA, 24 bp, Homo sapiens
ttgtcctctagggcctgcagtctc

SEQ ID NO: 40154 - DNA, 19 bp, Homo sapiens
tgtcctctagggcctgcag

SEQ ID NO: 40155 - DNA, 20 bp, Homo sapiens
tgtcctctagggcctgcagt

SEQ ID NO: 40156 - DNA, 21 bp, Homo sapiens
tgtcctctagggcctgcagtc

SEQ ID NO: 40157 - DNA, 23 bp, Homo sapiens
tgtcctctagggcctgcagtctc

SEQ ID NO: 40158 - DNA, 24 bp, Homo sapiens
tgtcctctagggcctgcagtctca

SEQ ID NO: 40159 - DNA, 26 bp, Homo sapiens
tgtcctctagggcctgcagtctcatg

SEQ ID NO: 40160 - DNA, 21 bp, Homo sapiens
gtcctctagggcctgcagtct

SEQ ID NO: 40161 - DNA, 21 bp, Homo sapiens
tagggcctgctgccccctgcc

SEQ ID NO: 40162 - DNA, 20 bp, Homo sapiens
tagggcctgctgccccctgc

SEQ ID NO: 40163 - DNA, 18 bp, Homo sapiens
tagggcctgctgccccct

SEQ ID NO: 40164 - DNA, 24 bp, Homo sapiens
aagcctctgtccccaccccaggcc

SEQ ID NO: 40165 - DNA, 25 bp, Homo sapiens
caagcctctgtccccaccccaggcc

SEQ ID NO: 40166 - DNA, 23 bp, Homo sapiens
aagcctctgtccccaccccaggc

SEQ ID NO: 40167 - DNA, 25 bp, Homo sapiens
ccaagcctctgtccccaccccaggc

SEQ ID NO: 40168 - DNA, 22 bp, Homo sapiens
aagcctctgtccccaccccagg

SEQ ID NO: 40169 - DNA, 23 bp, Homo sapiens
caagcctctgtccccaccccagg

SEQ ID NO: 40170 - DNA, 22 bp, Homo sapiens
caagcctctgtccccaccccag

SEQ ID NO: 40171 - DNA, 23 bp, Homo sapiens
ttggggtggagggccaaggagct

SEQ ID NO: 40172 - DNA, 21 bp, Homo sapiens
ttggggtggagggccaaggag

SEQ ID NO: 40173 - DNA, 20 bp, Homo sapiens
ttggggtggagggccaagga

SEQ ID NO: 40174 - DNA, 16 bp, Homo sapiens
gtccgttggtcggtcg

SEQ ID NO: 40175 - DNA, 20 bp, Homo sapiens
gtaggtccgttggtcggtcg

SEQ ID NO: 40176 - DNA, 24 bp, Homo sapiens
ggcggagggaagtaggtccgttgg

SEQ ID NO: 40177 - DNA, 25 bp, Homo sapiens
gggcggagggaagtaggtccgttgg

SEQ ID NO: 40178 - DNA, 19 bp, Homo sapiens
gagggaagtaggtccgttg

SEQ ID NO: 40179 - DNA, 23 bp, Homo sapiens
ggcggagggaagtaggtccgttg

SEQ ID NO: 40180 - DNA, 24 bp, Homo sapiens
gggcggagggaagtaggtccgttg

SEQ ID NO: 40181 - DNA, 20 bp, Homo sapiens
cggagggaagtaggtccgtt

SEQ ID NO: 40182 - DNA, 21 bp, Homo sapiens
ggcggagggaagtaggtccgt

SEQ ID NO: 40183 - DNA, 22 bp, Homo sapiens
gggcggagggaagtaggtccgt

SEQ ID NO: 40184 - DNA, 16 bp, Homo sapiens
gagggaagtaggtccg

SEQ ID NO: 40185 - DNA, 18 bp, Homo sapiens
cggagggaagtaggtccg

SEQ ID NO: 40186 - DNA, 21 bp, Homo sapiens
cagggcggagggaagtaggtc

SEQ ID NO: 40187 - DNA, 22 bp, Homo sapiens
tcagggcggagggaagtaggtc

SEQ ID NO: 40188 - DNA, 23 bp, Homo sapiens
ctcagggcggagggaagtaggtc

SEQ ID NO: 40189 - DNA, 24 bp, Homo sapiens
actcagggcggagggaagtaggtc

SEQ ID NO: 40190 - DNA, 17 bp, Homo sapiens
agggcggagggaagtag

SEQ ID NO: 40191 - DNA, 20 bp, Homo sapiens
ctcagggcggagggaagtag

SEQ ID NO: 40192 - DNA, 18 bp, Homo sapiens
ctcagggcggagggaagt

SEQ ID NO: 40193 - DNA, 18 bp, Homo sapiens
actcagggcggagggaag

SEQ ID NO: 40194 - DNA, 17 bp, Homo sapiens
actcagggcggagggaa

SEQ ID NO: 40195 - DNA, 16 bp, Homo sapiens
actcagggcggaggga

SEQ ID NO: 40196 - DNA, 22 bp, Homo sapiens
gttcagggagggtccccaacaa

SEQ ID NO: 40197 - DNA, 24 bp, Homo sapiens
ttggttcagggagggtccccaaca

SEQ ID NO: 40198 - DNA, 25 bp, Homo sapiens
cttggttcagggagggtccccaaca

SEQ ID NO: 40199 - DNA, 23 bp, Homo sapiens
ttggttcagggagggtccccaac

SEQ ID NO: 40200 - DNA, 24 bp, Homo sapiens
cttggttcagggagggtccccaac

SEQ ID NO: 40201 - DNA, 22 bp, Homo sapiens
ttggttcagggagggtccccaa

SEQ ID NO: 40202 - DNA, 23 bp, Homo sapiens
cttggttcagggagggtccccaa

SEQ ID NO: 40203 - DNA, 24 bp, Homo sapiens
ccttggttcagggagggtccccaa

SEQ ID NO: 40204 - DNA, 20 bp, Homo sapiens
tggttcagggagggtcccca

SEQ ID NO: 40205 - DNA, 21 bp, Homo sapiens
ttggttcagggagggtcccca

SEQ ID NO: 40206 - DNA, 23 bp, Homo sapiens
ccttggttcagggagggtcccca

SEQ ID NO: 40207 - DNA, 21 bp, Homo sapiens
cttggttcagggagggtcccc

SEQ ID NO: 40208 - DNA, 22 bp, Homo sapiens
ccttggttcagggagggtcccc

SEQ ID NO: 40209 - DNA, 23 bp, Homo sapiens
tccttggttcagggagggtcccc

SEQ ID NO: 40210 - DNA, 21 bp, Homo sapiens
ccttggttcagggagggtccc

SEQ ID NO: 40211 - DNA, 19 bp, Homo sapiens
cttggttcagggagggtcc

SEQ ID NO: 40212 - DNA, 21 bp, Homo sapiens
tccttggttcagggagggtcc

SEQ ID NO: 40213 - DNA, 22 bp, Homo sapiens
ttccttggttcagggagggtcc

SEQ ID NO: 40214 - DNA, 18 bp, Homo sapiens
cttggttcagggagggtc

SEQ ID NO: 40215 - DNA, 20 bp, Homo sapiens
tccttggttcagggagggtc

SEQ ID NO: 40216 - DNA, 21 bp, Homo sapiens
ttccttggttcagggagggtc

SEQ ID NO: 40217 - DNA, 20 bp, Homo sapiens
ttccttggttcagggagggt

SEQ ID NO: 40218 - DNA, 20 bp, Homo sapiens
cttccttggttcagggaggg

SEQ ID NO: 40219 - DNA, 18 bp, Homo sapiens
ttccttggttcagggagg

SEQ ID NO: 40220 - DNA, 19 bp, Homo sapiens
cttccttggttcagggagg

SEQ ID NO: 40221 - DNA, 17 bp, Homo sapiens
tgaaccaaggaagagtc

SEQ ID NO: 40222 - DNA, 19 bp, Homo sapiens
cctgaaccaaggaagagtc

SEQ ID NO: 40223 - DNA, 22 bp, Homo sapiens
ttccctgaaccaaggaagagtc

SEQ ID NO: 40224 - DNA, 25 bp, Homo sapiens
accttccctgaaccaaggaagagtc

SEQ ID NO: 40225 - DNA, 26 bp, Homo sapiens
aggaccttccctgaaccaaggaagag

SEQ ID NO: 40226 - DNA, 23 bp, Homo sapiens
gaccttccctgaaccaaggaaga

SEQ ID NO: 40227 - DNA, 22 bp, Homo sapiens
gaccttccctgaaccaaggaag

SEQ ID NO: 40228 - DNA, 23 bp, Homo sapiens
ggaccttccctgaaccaaggaag

SEQ ID NO: 40229 - DNA, 24 bp, Homo sapiens
aggaccttccctgaaccaaggaag

SEQ ID NO: 40230 - DNA, 21 bp, Homo sapiens
gaccttccctgaaccaaggaa

SEQ ID NO: 40231 - DNA, 22 bp, Homo sapiens
ggaccttccctgaaccaaggaa

SEQ ID NO: 40232 - DNA, 23 bp, Homo sapiens
aggaccttccctgaaccaaggaa

SEQ ID NO: 40233 - DNA, 20 bp, Homo sapiens
gaccttccctgaaccaagga

SEQ ID NO: 40234 - DNA, 21 bp, Homo sapiens
ggaccttccctgaaccaagga

SEQ ID NO: 40235 - DNA, 23 bp, Homo sapiens
caggaccttccctgaaccaagga

SEQ ID NO: 40236 - DNA, 21 bp, Homo sapiens
aggaccttccctgaaccaagg

SEQ ID NO: 40237 - DNA, 22 bp, Homo sapiens
caggaccttccctgaaccaagg

SEQ ID NO: 40238 - DNA, 20 bp, Homo sapiens
aggaccttccctgaaccaag

SEQ ID NO: 40239 - DNA, 24 bp, Homo sapiens
ccttctgcggcagagctggggtca

SEQ ID NO: 40240 - DNA, 22 bp, Homo sapiens
ttctgcggcagagctggggtca

SEQ ID NO: 40241 - DNA, 24 bp, Homo sapiens
ttctgcggcagagctggggtcacc

SEQ ID NO: 40242 - DNA, 21 bp, Homo sapiens
tctgcggcagagctggggtca

SEQ ID NO: 40243 - DNA, 22 bp, Homo sapiens
tctgcggcagagctggggtcac

SEQ ID NO: 40244 - DNA, 23 bp, Homo sapiens
tctgcggcagagctggggtcacc

SEQ ID NO: 40245 - DNA, 26 bp, Homo sapiens
tctgcggcagagctggggtcaccagc

SEQ ID NO: 40246 - DNA, 20 bp, Homo sapiens
ctgcggcagagctggggtca

SEQ ID NO: 40247 - DNA, 22 bp, Homo sapiens
ctgcggcagagctggggtcacc

SEQ ID NO: 40248 - DNA, 23 bp, Homo sapiens
ctgcggcagagctggggtcacca

SEQ ID NO: 40249 - DNA, 24 bp, Homo sapiens
ctgcggcagagctggggtcaccag

SEQ ID NO: 40250 - DNA, 17 bp, Homo sapiens
tgcggcagagctggggt

SEQ ID NO: 40251 - DNA, 18 bp, Homo sapiens
tgcggcagagctggggtc

SEQ ID NO: 40252 - DNA, 20 bp, Homo sapiens
tgcggcagagctggggtcac

SEQ ID NO: 40253 - DNA, 21 bp, Homo sapiens
tgcggcagagctggggtcacc

SEQ ID NO: 40254 - DNA, 22 bp, Homo sapiens
tgcggcagagctggggtcacca

SEQ ID NO: 40255 - DNA, 23 bp, Homo sapiens
tgcggcagagctggggtcaccag

SEQ ID NO: 40256 - DNA, 24 bp, Homo sapiens
tgcggcagagctggggtcaccagc

SEQ ID NO: 40257 - DNA, 19 bp, Homo sapiens
agagctggggtcaccagcc

SEQ ID NO: 40258 - DNA, 19 bp, Homo sapiens
tgtgacttctcccctgcca

SEQ ID NO: 40259 - DNA, 21 bp, Homo sapiens
tgtgacttctcccctgccaca

SEQ ID NO: 40260 - DNA, 23 bp, Homo sapiens
tgtgacttctcccctgccacagg

SEQ ID NO: 40261 - DNA, 24 bp, Homo sapiens
tgtgacttctcccctgccacaggg

SEQ ID NO: 40262 - DNA, 22 bp, Homo sapiens
gtgacttctcccctgccacagg

SEQ ID NO: 40263 - DNA, 23 bp, Homo sapiens
gtgacttctcccctgccacaggg

SEQ ID NO: 40264 - DNA, 21 bp, Homo sapiens
tgacttctcccctgccacagg

SEQ ID NO: 40265 - DNA, 22 bp, Homo sapiens
tgacttctcccctgccacaggg

SEQ ID NO: 40266 - DNA, 23 bp, Homo sapiens
ttatgcaggcctgtgtacagcac

SEQ ID NO: 40267 - DNA, 23 bp, Homo sapiens
tatgcaggcctgtgtacagcact

SEQ ID NO: 40268 - DNA, 24 bp, Homo sapiens
tatgcaggcctgtgtacagcactc

SEQ ID NO: 40269 - DNA, 23 bp, Homo sapiens
atgcaggcctgtgtacagcactc

SEQ ID NO: 40270 - DNA, 24 bp, Homo sapiens
atgcaggcctgtgtacagcactca

SEQ ID NO: 40271 - DNA, 21 bp, Homo sapiens
gcaggcctgtgtacagcactc

SEQ ID NO: 40272 - DNA, 19 bp, Homo sapiens
ctgtgtacagcactcaggc

SEQ ID NO: 40273 - DNA, 18 bp, Homo sapiens
agcctgtgcttgtccctg

SEQ ID NO: 40274 - DNA, 19 bp, Homo sapiens
agcctgtgcttgtccctgc

SEQ ID NO: 40275 - DNA, 22 bp, Homo sapiens
agcctgtgcttgtccctgcaga

SEQ ID NO: 40276 - DNA, 23 bp, Homo sapiens
agcctgtgcttgtccctgcagag

SEQ ID NO: 40277 - DNA, 24 bp, Homo sapiens
agcctgtgcttgtccctgcagagt

SEQ ID NO: 40278 - DNA, 20 bp, Homo sapiens
gcctgtgcttgtccctgcag

SEQ ID NO: 40279 - DNA, 21 bp, Homo sapiens
gcctgtgcttgtccctgcaga

SEQ ID NO: 40280 - DNA, 22 bp, Homo sapiens
gcctgtgcttgtccctgcagag

SEQ ID NO: 40281 - DNA, 17 bp, Homo sapiens
ttgctggcttgcactgt

SEQ ID NO: 40282 - DNA, 26 bp, Homo sapiens
tgtcgtggggcttgctggcttgcact

SEQ ID NO: 40283 - DNA, 23 bp, Homo sapiens
ctgcaggcacagacagccctggc

SEQ ID NO: 40284 - DNA, 22 bp, Homo sapiens
agaggcagagaggctcagggtc

SEQ ID NO: 40285 - DNA, 23 bp, Homo sapiens
cagaggcagagaggctcagggtc

SEQ ID NO: 40286 - DNA, 25 bp, Homo sapiens
agcagaggcagagaggctcagggtc

SEQ ID NO: 40287 - DNA, 23 bp, Homo sapiens
agcagaggcagagaggctcaggg

SEQ ID NO: 40288 - DNA, 21 bp, Homo sapiens
agcagaggcagagaggctcag

SEQ ID NO: 40289 - DNA, 18 bp, Homo sapiens
cagaggcagagaggctca

SEQ ID NO: 40290 - DNA, 20 bp, Homo sapiens
agcagaggcagagaggctca

SEQ ID NO: 40291 - DNA, 19 bp, Homo sapiens
agcagaggcagagaggctc

SEQ ID NO: 40292 - DNA, 27 bp, Homo sapiens
gaggctctgttagccttggctctgggt

SEQ ID NO: 40293 - DNA, 27 bp, Homo sapiens
tgaggctctgttagccttggctctggg

SEQ ID NO: 40294 - DNA, 26 bp, Homo sapiens
tgaggctctgttagccttggctctgg

SEQ ID NO: 40295 - DNA, 24 bp, Homo sapiens
tgaggctctgttagccttggctct

SEQ ID NO: 40296 - DNA, 22 bp, Homo sapiens
tgaggctctgttagccttggct

SEQ ID NO: 40297 - DNA, 21 bp, Homo sapiens
tgaggctctgttagccttggc

SEQ ID NO: 40298 - DNA, 20 bp, Homo sapiens
tgaggctctgttagccttgg

SEQ ID NO: 40299 - DNA, 23 bp, Homo sapiens
acctgaggctctgttagccttgg

SEQ ID NO: 40300 - DNA, 22 bp, Homo sapiens
acctgaggctctgttagccttg

SEQ ID NO: 40301 - DNA, 26 bp, Homo sapiens
tgaagccagctctggtctgggccatt

SEQ ID NO: 40302 - DNA, 25 bp, Homo sapiens
tgaagccagctctggtctgggccat

SEQ ID NO: 40303 - DNA, 24 bp, Homo sapiens
tgaagccagctctggtctgggcca

SEQ ID NO: 40304 - DNA, 23 bp, Homo sapiens
tgaagccagctctggtctgggcc

SEQ ID NO: 40305 - DNA, 23 bp, Homo sapiens
gtgaagccagctctggtctgggc

SEQ ID NO: 40306 - DNA, 20 bp, Homo sapiens
tgaagccagctctggtctgg

SEQ ID NO: 40307 - DNA, 25 bp, Homo sapiens
gagaccaggactggatgcaccactc

SEQ ID NO: 40308 - DNA, 26 bp, Homo sapiens
tgagaccaggactggatgcaccactc

SEQ ID NO: 40309 - DNA, 24 bp, Homo sapiens
tgagaccaggactggatgcaccac

SEQ ID NO: 40310 - DNA, 23 bp, Homo sapiens
tgagaccaggactggatgcacca

SEQ ID NO: 40311 - DNA, 23 bp, Homo sapiens
ctgagaccaggactggatgcacc

SEQ ID NO: 40312 - DNA, 21 bp, Homo sapiens
tgagaccaggactggatgcac

SEQ ID NO: 40313 - DNA, 22 bp, Homo sapiens
ctgagaccaggactggatgcac

SEQ ID NO: 40314 - DNA, 20 bp, Homo sapiens
tgagaccaggactggatgca

SEQ ID NO: 40315 - DNA, 21 bp, Homo sapiens
ctgagaccaggactggatgca

SEQ ID NO: 40316 - DNA, 18 bp, Homo sapiens
tgagaccaggactggatg

SEQ ID NO: 40317 - DNA, 20 bp, Homo sapiens
ggcctgagaccaggactgga

SEQ ID NO: 40318 - DNA, 22 bp, Homo sapiens
caattgctcttttggaaggaac

SEQ ID NO: 40319 - DNA, 23 bp, Homo sapiens
agcaattgctcttttggaaggaa

SEQ ID NO: 40320 - DNA, 22 bp, Homo sapiens
agcaattgctcttttggaagga

SEQ ID NO: 40321 - DNA, 23 bp, Homo sapiens
tagcaattgctcttttggaagga

SEQ ID NO: 40322 - DNA, 22 bp, Homo sapiens
tagcaattgctcttttggaagg

SEQ ID NO: 40323 - DNA, 23 bp, Homo sapiens
atagcaattgctcttttggaagg

SEQ ID NO: 40324 - DNA, 22 bp, Homo sapiens
atagcaattgctcttttggaag

SEQ ID NO: 40325 - DNA, 25 bp, Homo sapiens
tctgaaagagcagttggtgtttatt

SEQ ID NO: 40326 - DNA, 23 bp, Homo sapiens
ctgaaagagcagttggtgtttat

SEQ ID NO: 40327 - DNA, 24 bp, Homo sapiens
tctgaaagagcagttggtgtttat

SEQ ID NO: 40328 - DNA, 23 bp, Homo sapiens
tctgaaagagcagttggtgttta

SEQ ID NO: 40329 - DNA, 21 bp, Homo sapiens
ctgaaagagcagttggtgttt

SEQ ID NO: 40330 - DNA, 22 bp, Homo sapiens
tctgaaagagcagttggtgttt

SEQ ID NO: 40331 - DNA, 20 bp, Homo sapiens
tctgaaagagcagttggtgt

SEQ ID NO: 40332 - DNA, 18 bp, Homo sapiens
tctggctccgtgtcttca

SEQ ID NO: 40333 - DNA, 19 bp, Homo sapiens
tctggctccgtgtcttcac

SEQ ID NO: 40334 - DNA, 20 bp, Homo sapiens
tctggctccgtgtcttcact

SEQ ID NO: 40335 - DNA, 21 bp, Homo sapiens
tctggctccgtgtcttcactc

SEQ ID NO: 40336 - DNA, 22 bp, Homo sapiens
tctggctccgtgtcttcactcc

SEQ ID NO: 40337 - DNA, 24 bp, Homo sapiens
tctggctccgtgtcttcactcccg

SEQ ID NO: 40338 - DNA, 25 bp, Homo sapiens
tctggctccgtgtcttcactcccgt

SEQ ID NO: 40339 - DNA, 19 bp, Homo sapiens
gagggagggacgggggctg

SEQ ID NO: 40340 - DNA, 20 bp, Homo sapiens
gagggagggacgggggctgt

SEQ ID NO: 40341 - DNA, 21 bp, Homo sapiens
gagggagggacgggggctgtg

SEQ ID NO: 40342 - DNA, 22 bp, Homo sapiens
gagggagggacgggggctgtgc

SEQ ID NO: 40343 - DNA, 23 bp, Homo sapiens
gagggagggacgggggctgtgct

SEQ ID NO: 40344 - DNA, 24 bp, Homo sapiens
gagggagggacgggggctgtgctg

SEQ ID NO: 40345 - DNA, 25 bp, Homo sapiens
gagggagggacgggggctgtgctgg

SEQ ID NO: 40346 - DNA, 24 bp, Homo sapiens
agggagggacgggggctgtgctgg

SEQ ID NO: 40347 - DNA, 18 bp, Homo sapiens
ctcttgtcgcctcctcct

SEQ ID NO: 40348 - DNA, 19 bp, Homo sapiens
ctcttgtcgcctcctcctc

SEQ ID NO: 40349 - DNA, 25 bp, Homo sapiens
ctcttgtcgcctcctcctctccccc

SEQ ID NO: 40350 - DNA, 23 bp, Homo sapiens
tgtcgcctcctcctctcccccct

SEQ ID NO: 40351 - DNA, 21 bp, Homo sapiens
gcctcctcctctccccccttt

SEQ ID NO: 40352 - DNA, 20 bp, Homo sapiens
cctcctcctctccccccttt

SEQ ID NO: 40353 - DNA, 19 bp, Homo sapiens
ctcctcctctccccccttt

SEQ ID NO: 40354 - DNA, 18 bp, Homo sapiens
tcctcctctccccccttt

SEQ ID NO: 40355 - DNA, 23 bp, Homo sapiens
tctgtgcccctacttcccaggag

SEQ ID NO: 40356 - DNA, 22 bp, Homo sapiens
tctgtgcccctacttcccagga

SEQ ID NO: 40357 - DNA, 23 bp, Homo sapiens
ctctgtgcccctacttcccagga

SEQ ID NO: 40358 - DNA, 20 bp, Homo sapiens
ctgtgcccctacttcccagg

SEQ ID NO: 40359 - DNA, 21 bp, Homo sapiens
tctgtgcccctacttcccagg

SEQ ID NO: 40360 - DNA, 22 bp, Homo sapiens
ctctgtgcccctacttcccagg

SEQ ID NO: 40361 - DNA, 21 bp, Homo sapiens
ctctgtgcccctacttcccag

SEQ ID NO: 40362 - DNA, 19 bp, Homo sapiens
tctgtgcccctacttccca

SEQ ID NO: 40363 - DNA, 19 bp, Homo sapiens
ctctgtgcccctacttccc

SEQ ID NO: 40364 - DNA, 22 bp, Homo sapiens
gagcctctgtgcccctacttcc

SEQ ID NO: 40365 - DNA, 27 bp, Homo sapiens
tcggggagtctggggtccggaattctc

SEQ ID NO: 40366 - DNA, 26 bp, Homo sapiens
gtcggggagtctggggtccggaattc

SEQ ID NO: 40367 - DNA, 25 bp, Homo sapiens
gtcggggagtctggggtccggaatt

SEQ ID NO: 40368 - DNA, 24 bp, Homo sapiens
gtcggggagtctggggtccggaat

SEQ ID NO: 40369 - DNA, 22 bp, Homo sapiens
tcggggagtctggggtccggaa

SEQ ID NO: 40370 - DNA, 21 bp, Homo sapiens
tcggggagtctggggtccgga

SEQ ID NO: 40371 - DNA, 22 bp, Homo sapiens
gtcggggagtctggggtccgga

SEQ ID NO: 40372 - DNA, 20 bp, Homo sapiens
tcggggagtctggggtccgg

SEQ ID NO: 40373 - DNA, 17 bp, Homo sapiens
gtgcattgtagttgcat

SEQ ID NO: 40374 - DNA, 18 bp, Homo sapiens
gtgcattgtagttgcatt

SEQ ID NO: 40375 - DNA, 19 bp, Homo sapiens
gtgcattgtagttgcattg

SEQ ID NO: 40376 - DNA, 20 bp, Homo sapiens
gtgcattgtagttgcattgc

SEQ ID NO: 40377 - DNA, 22 bp, Homo sapiens
gtgcattgtagttgcattgcat

SEQ ID NO: 40378 - DNA, 23 bp, Homo sapiens
gtgcattgtagttgcattgcatg

SEQ ID NO: 40379 - DNA, 24 bp, Homo sapiens
gtgcattgtagttgcattgcatgt

SEQ ID NO: 40380 - DNA, 26 bp, Homo sapiens
gtgcattgtagttgcattgcatgttc

SEQ ID NO: 40381 - DNA, 24 bp, Homo sapiens
catgcaatgtttccacagtgcatc

SEQ ID NO: 40382 - DNA, 23 bp, Homo sapiens
atgcaatgtttccacagtgcatc

SEQ ID NO: 40383 - DNA, 22 bp, Homo sapiens
tgcaatgtttccacagtgcatc

SEQ ID NO: 40384 - DNA, 18 bp, Homo sapiens
caatgtttccacagtgca

SEQ ID NO: 40385 - DNA, 19 bp, Homo sapiens
caatgtttccacagtgcat

SEQ ID NO: 40386 - DNA, 20 bp, Homo sapiens
caatgtttccacagtgcatc

SEQ ID NO: 40387 - DNA, 21 bp, Homo sapiens
caatgtttccacagtgcatca

SEQ ID NO: 40388 - DNA, 23 bp, Homo sapiens
caatgtttccacagtgcatcaca

SEQ ID NO: 40389 - DNA, 26 bp, Homo sapiens
caatgtttccacagtgcatcacagag

SEQ ID NO: 40390 - DNA, 18 bp, Homo sapiens
aatgtttccacagtgcat

SEQ ID NO: 40391 - DNA, 20 bp, Homo sapiens
aatgtttccacagtgcatca

SEQ ID NO: 40392 - DNA, 27 bp, Homo sapiens
actggactaggagtcagaaggtggagt

SEQ ID NO: 40393 - DNA, 26 bp, Homo sapiens
actggactaggagtcagaaggtggag

SEQ ID NO: 40394 - DNA, 25 bp, Homo sapiens
actggactaggagtcagaaggtgga

SEQ ID NO: 40395 - DNA, 24 bp, Homo sapiens
actggactaggagtcagaaggtgg

SEQ ID NO: 40396 - DNA, 23 bp, Homo sapiens
actggactaggagtcagaaggtg

SEQ ID NO: 40397 - DNA, 21 bp, Homo sapiens
ctggactaggagtcagaaggt

SEQ ID NO: 40398 - DNA, 22 bp, Homo sapiens
actggactaggagtcagaaggt

SEQ ID NO: 40399 - DNA, 19 bp, Homo sapiens
gggagcactggactaggag

SEQ ID NO: 40400 - DNA, 24 bp, Homo sapiens
acgcccttcccccccttcttcacc

SEQ ID NO: 40401 - DNA, 25 bp, Homo sapiens
aacgcccttcccccccttcttcacc

SEQ ID NO: 40402 - DNA, 23 bp, Homo sapiens
acgcccttcccccccttcttcac

SEQ ID NO: 40403 - DNA, 21 bp, Homo sapiens
acgcccttcccccccttcttc

SEQ ID NO: 40404 - DNA, 20 bp, Homo sapiens
acgcccttcccccccttctt

SEQ ID NO: 40405 - DNA, 19 bp, Homo sapiens
acgcccttcccccccttct

SEQ ID NO: 40406 - DNA, 21 bp, Homo sapiens
ataccccaaatcttgatcaga

SEQ ID NO: 40407 - DNA, 21 bp, Homo sapiens
ccccaaatcttgatcagaagc

SEQ ID NO: 40408 - DNA, 22 bp, Homo sapiens
ccccaaatcttgatcagaagcc

SEQ ID NO: 40409 - DNA, 23 bp, Homo sapiens
ccccaaatcttgatcagaagcct

SEQ ID NO: 40410 - DNA, 24 bp, Homo sapiens
ccccaaatcttgatcagaagcctt

SEQ ID NO: 40411 - DNA, 23 bp, Homo sapiens
cccaaatcttgatcagaagcctt

SEQ ID NO: 40412 - DNA, 20 bp, Homo sapiens
ccaaatcttgatcagaagcc

SEQ ID NO: 40413 - DNA, 22 bp, Homo sapiens
ccaaatcttgatcagaagcctt

SEQ ID NO: 40414 - DNA, 23 bp, Homo sapiens
ccaaatcttgatcagaagccttg

SEQ ID NO: 40415 - DNA, 25 bp, Homo sapiens
caaatcttgatcagaagccttgatc

SEQ ID NO: 40416 - DNA, 21 bp, Homo sapiens
aatcttgatcagaagccttga

SEQ ID NO: 40417 - DNA, 21 bp, Homo sapiens
aggcttctgatcaagatttgt

SEQ ID NO: 40418 - DNA, 22 bp, Homo sapiens
aggcttctgatcaagatttgtg

SEQ ID NO: 40419 - DNA, 23 bp, Homo sapiens
aggcttctgatcaagatttgtgg

SEQ ID NO: 40420 - DNA, 21 bp, Homo sapiens
ggcttctgatcaagatttgtg

SEQ ID NO: 40421 - DNA, 22 bp, Homo sapiens
ggcttctgatcaagatttgtgg

SEQ ID NO: 40422 - DNA, 23 bp, Homo sapiens
ggcttctgatcaagatttgtggt

SEQ ID NO: 40423 - DNA, 21 bp, Homo sapiens
cttctgatcaagatttgtggt

SEQ ID NO: 40424 - DNA, 23 bp, Homo sapiens
cttctgatcaagatttgtggtgt

SEQ ID NO: 40425 - DNA, 16 bp, Homo sapiens
ttgcactcagcaggca

SEQ ID NO: 40426 - DNA, 25 bp, Homo sapiens
cactcagcaggcaggctggtgcagc

SEQ ID NO: 40427 - DNA, 19 bp, Homo sapiens
tcagcaggcaggctggtgc

SEQ ID NO: 40428 - DNA, 20 bp, Homo sapiens
tcagcaggcaggctggtgca

SEQ ID NO: 40429 - DNA, 21 bp, Homo sapiens
tcagcaggcaggctggtgcag

SEQ ID NO: 40430 - DNA, 23 bp, Homo sapiens
tcagcaggcaggctggtgcagcc

SEQ ID NO: 40431 - DNA, 24 bp, Homo sapiens
tcagcaggcaggctggtgcagccc

SEQ ID NO: 40432 - DNA, 25 bp, Homo sapiens
tcagcaggcaggctggtgcagcccg

SEQ ID NO: 40433 - DNA, 26 bp, Homo sapiens
tcagcaggcaggctggtgcagcccgt

SEQ ID NO: 40434 - DNA, 27 bp, Homo sapiens
tcagcaggcaggctggtgcagcccgtg

SEQ ID NO: 40435 - DNA, 22 bp, Homo sapiens
tggtgggggaccatcctgcctg

SEQ ID NO: 40436 - DNA, 19 bp, Homo sapiens
gggaccatcctgcctgctg

SEQ ID NO: 40437 - DNA, 21 bp, Homo sapiens
gggaccatcctgcctgctgtg

SEQ ID NO: 40438 - DNA, 23 bp, Homo sapiens
gggaccatcctgcctgctgtggg

SEQ ID NO: 40439 - DNA, 24 bp, Homo sapiens
gggaccatcctgcctgctgtgggg

SEQ ID NO: 40440 - DNA, 25 bp, Homo sapiens
gggaccatcctgcctgctgtggggt

SEQ ID NO: 40441 - DNA, 26 bp, Homo sapiens
gggaccatcctgcctgctgtggggta

SEQ ID NO: 40442 - DNA, 27 bp, Homo sapiens
gggaccatcctgcctgctgtggggtaa

SEQ ID NO: 40443 - DNA, 21 bp, Homo sapiens
ggaccatcctgcctgctgtgg

SEQ ID NO: 40444 - DNA, 22 bp, Homo sapiens
ggaccatcctgcctgctgtggg

SEQ ID NO: 40445 - DNA, 23 bp, Homo sapiens
ggaccatcctgcctgctgtgggg

SEQ ID NO: 40446 - DNA, 24 bp, Homo sapiens
ggaccatcctgcctgctgtggggt

SEQ ID NO: 40447 - DNA, 19 bp, Homo sapiens
gaccatcctgcctgctgtg

SEQ ID NO: 40448 - DNA, 20 bp, Homo sapiens
gaccatcctgcctgctgtgg

SEQ ID NO: 40449 - DNA, 22 bp, Homo sapiens
gaccatcctgcctgctgtgggg

SEQ ID NO: 40450 - DNA, 23 bp, Homo sapiens
gaccatcctgcctgctgtggggt

SEQ ID NO: 40451 - DNA, 24 bp, Homo sapiens
gaccatcctgcctgctgtggggta

SEQ ID NO: 40452 - DNA, 25 bp, Homo sapiens
gaccatcctgcctgctgtggggtaa

SEQ ID NO: 40453 - DNA, 19 bp, Homo sapiens
gtgaggtagtaggttgtat

SEQ ID NO: 40454 - DNA, 20 bp, Homo sapiens
gtgaggtagtaggttgtata

SEQ ID NO: 40455 - DNA, 21 bp, Homo sapiens
gtgaggtagtaggttgtatag

SEQ ID NO: 40456 - DNA, 22 bp, Homo sapiens
gtgaggtagtaggttgtatagt

SEQ ID NO: 40457 - DNA, 23 bp, Homo sapiens
gtgaggtagtaggttgtatagtt

SEQ ID NO: 40458 - DNA, 24 bp, Homo sapiens
gtgaggtagtaggttgtatagttt

SEQ ID NO: 40459 - DNA, 24 bp, Homo sapiens
tgaggtagtaggttgtatagtttg

SEQ ID NO: 40460 - DNA, 25 bp, Homo sapiens
tgaggtagtaggttgtatagtttgg

SEQ ID NO: 40461 - DNA, 26 bp, Homo sapiens
tgaggtagtaggttgtatagtttggg

SEQ ID NO: 40462 - DNA, 22 bp, Homo sapiens
ggataactatacaatctactgt

SEQ ID NO: 40463 - DNA, 26 bp, Homo sapiens
ggataactatacaatctactgtcttt

SEQ ID NO: 40464 - DNA, 27 bp, Homo sapiens
ggataactatacaatctactgtctttc

SEQ ID NO: 40465 - DNA, 28 bp, Homo sapiens
ggataactatacaatctactgtctttcc

SEQ ID NO: 40466 - DNA, 24 bp, Homo sapiens
ctatacaatctactgtctttcctg

SEQ ID NO: 40467 - DNA, 25 bp, Homo sapiens
ctatacaatctactgtctttcctga

SEQ ID NO: 40468 - DNA, 26 bp, Homo sapiens
ctatacaatctactgtctttcctgaa

SEQ ID NO: 40469 - DNA, 27 bp, Homo sapiens
ctatacaatctactgtctttcctgaag

SEQ ID NO: 40470 - DNA, 23 bp, Homo sapiens
tatacaatctactgtctttcctg

SEQ ID NO: 40471 - DNA, 24 bp, Homo sapiens
tatacaatctactgtctttcctga

SEQ ID NO: 40472 - DNA, 26 bp, Homo sapiens
tatacaatctactgtctttcctgaag

SEQ ID NO: 40473 - DNA, 22 bp, Homo sapiens
atacaatctactgtctttcctg

SEQ ID NO: 40474 - DNA, 23 bp, Homo sapiens
atacaatctactgtctttcctga

SEQ ID NO: 40475 - DNA, 24 bp, Homo sapiens
atacaatctactgtctttcctgaa

SEQ ID NO: 40476 - DNA, 25 bp, Homo sapiens
atacaatctactgtctttcctgaag

SEQ ID NO: 40477 - DNA, 21 bp, Homo sapiens
tacaatctactgtctttcctg

SEQ ID NO: 40478 - DNA, 22 bp, Homo sapiens
tacaatctactgtctttcctga

SEQ ID NO: 40479 - DNA, 23 bp, Homo sapiens
tacaatctactgtctttcctgaa

SEQ ID NO: 40480 - DNA, 22 bp, Homo sapiens
acaatctactgtctttcctgaa

SEQ ID NO: 40481 - DNA, 24 bp, Homo sapiens
cgcctgcccagccctcctgctctg

SEQ ID NO: 40482 - DNA, 27 bp, Homo sapiens
cgcctgcccagccctcctgctctggtg

SEQ ID NO: 40483 - DNA, 20 bp, Homo sapiens
gcctgcccagccctcctgct

SEQ ID NO: 40484 - DNA, 22 bp, Homo sapiens
gcctgcccagccctcctgctct

SEQ ID NO: 40485 - DNA, 24 bp, Homo sapiens
gcctgcccagccctcctgctctgg

SEQ ID NO: 40486 - DNA, 24 bp, Homo sapiens
cctgcccagccctcctgctctggt

SEQ ID NO: 40487 - DNA, 25 bp, Homo sapiens
cctgcccagccctcctgctctggtg

SEQ ID NO: 40488 - DNA, 21 bp, Homo sapiens
ctgcccagccctcctgctctg

SEQ ID NO: 40489 - DNA, 22 bp, Homo sapiens
ctgcccagccctcctgctctgg

SEQ ID NO: 40490 - DNA, 23 bp, Homo sapiens
ctgcccagccctcctgctctggt

SEQ ID NO: 40491 - DNA, 24 bp, Homo sapiens
ctgcccagccctcctgctctggtg

SEQ ID NO: 40492 - DNA, 23 bp, Homo sapiens
tgcccagccctcctgctctggtg

SEQ ID NO: 40493 - DNA, 19 bp, Homo sapiens
cagccctcctgctctggtg

SEQ ID NO: 40494 - DNA, 23 bp, Homo sapiens
ccaggcaggggctggtgctgggc

SEQ ID NO: 40495 - DNA, 23 bp, Homo sapiens
caggcaggggctggtgctgggcg

SEQ ID NO: 40496 - DNA, 23 bp, Homo sapiens
aggcaggggctggtgctgggcgg

SEQ ID NO: 40497 - DNA, 25 bp, Homo sapiens
aggcaggggctggtgctgggcgggg

SEQ ID NO: 40498 - DNA, 26 bp, Homo sapiens
aggcaggggctggtgctgggcggggg

SEQ ID NO: 40499 - DNA, 27 bp, Homo sapiens
aggcaggggctggtgctgggcgggggg

SEQ ID NO: 40500 - DNA, 20 bp, Homo sapiens
tgaggtagtaggttgtgtgg

SEQ ID NO: 40501 - DNA, 21 bp, Homo sapiens
tgaggtagtaggttgtgtggt

SEQ ID NO: 40502 - DNA, 23 bp, Homo sapiens
tgaggtagtaggttgtgtggttt

SEQ ID NO: 40503 - DNA, 24 bp, Homo sapiens
tgaggtagtaggttgtgtggtttc

SEQ ID NO: 40504 - DNA, 26 bp, Homo sapiens
tgaggtagtaggttgtgtggtttcag

SEQ ID NO: 40505 - DNA, 20 bp, Homo sapiens
agataactatacaacctact

SEQ ID NO: 40506 - DNA, 21 bp, Homo sapiens
agataactatacaacctactg

SEQ ID NO: 40507 - DNA, 18 bp, Homo sapiens
ctatacaacctactgcct

SEQ ID NO: 40508 - DNA, 19 bp, Homo sapiens
ctatacaacctactgcctt

SEQ ID NO: 40509 - DNA, 20 bp, Homo sapiens
ctatacaacctactgccttc

SEQ ID NO: 40510 - DNA, 21 bp, Homo sapiens
ctatacaacctactgccttcc

SEQ ID NO: 40511 - DNA, 23 bp, Homo sapiens
ctatacaacctactgccttccct

SEQ ID NO: 40512 - DNA, 24 bp, Homo sapiens
ctatacaacctactgccttccctg

SEQ ID NO: 40513 - DNA, 25 bp, Homo sapiens
ctatacaacctactgccttccctga

SEQ ID NO: 40514 - DNA, 25 bp, Homo sapiens
ccttcctctccatgggtctttcatc

SEQ ID NO: 40515 - DNA, 26 bp, Homo sapiens
accttcctctccatgggtctttcatc

SEQ ID NO: 40516 - DNA, 24 bp, Homo sapiens
accttcctctccatgggtctttca

SEQ ID NO: 40517 - DNA, 22 bp, Homo sapiens
ccttcctctccatgggtctttc

SEQ ID NO: 40518 - DNA, 23 bp, Homo sapiens
accttcctctccatgggtctttc

SEQ ID NO: 40519 - DNA, 24 bp, Homo sapiens
aaccttcctctccatgggtctttc

SEQ ID NO: 40520 - DNA, 21 bp, Homo sapiens
ccttcctctccatgggtcttt

SEQ ID NO: 40521 - DNA, 20 bp, Homo sapiens
accttcctctccatgggtct

SEQ ID NO: 40522 - DNA, 19 bp, Homo sapiens
accttcctctccatgggtc

SEQ ID NO: 40523 - DNA, 20 bp, Homo sapiens
aaccttcctctccatgggtc

SEQ ID NO: 40524 - DNA, 18 bp, Homo sapiens
accttcctctccatgggt

SEQ ID NO: 40525 - DNA, 17 bp, Homo sapiens
accttcctctccatggg

SEQ ID NO: 40526 - DNA, 23 bp, Homo sapiens
agacccattgaggagaaggttct

SEQ ID NO: 40527 - DNA, 22 bp, Homo sapiens
agacccattgaggagaaggttc

SEQ ID NO: 40528 - DNA, 23 bp, Homo sapiens
aagacccattgaggagaaggttc

SEQ ID NO: 40529 - DNA, 24 bp, Homo sapiens
aaagacccattgaggagaaggttc

SEQ ID NO: 40530 - DNA, 21 bp, Homo sapiens
agacccattgaggagaaggtt

SEQ ID NO: 40531 - DNA, 22 bp, Homo sapiens
aagacccattgaggagaaggtt

SEQ ID NO: 40532 - DNA, 23 bp, Homo sapiens
aaagacccattgaggagaaggtt

SEQ ID NO: 40533 - DNA, 20 bp, Homo sapiens
ctccaggtgcgtggtggctc

SEQ ID NO: 40534 - DNA, 16 bp, Homo sapiens
gtgcgtggtggctcga

SEQ ID NO: 40535 - DNA, 19 bp, Homo sapiens
gtgcgtggtggctcgaggc

SEQ ID NO: 40536 - DNA, 20 bp, Homo sapiens
gtgcgtggtggctcgaggcg

SEQ ID NO: 40537 - DNA, 21 bp, Homo sapiens
gtgcgtggtggctcgaggcgg

SEQ ID NO: 40538 - DNA, 22 bp, Homo sapiens
gtgcgtggtggctcgaggcggg

SEQ ID NO: 40539 - DNA, 24 bp, Homo sapiens
gtgcgtggtggctcgaggcggggg

SEQ ID NO: 40540 - DNA, 25 bp, Homo sapiens
gtgcgtggtggctcgaggcgggggt

SEQ ID NO: 40541 - DNA, 26 bp, Homo sapiens
gtgcgtggtggctcgaggcgggggtg

SEQ ID NO: 40542 - DNA, 28 bp, Homo sapiens
gtgcgtggtggctcgaggcgggggtggg

SEQ ID NO: 40543 - DNA, 19 bp, Homo sapiens
tgcgtggtggctcgaggcg

SEQ ID NO: 40544 - DNA, 23 bp, Homo sapiens
tgcgtggtggctcgaggcggggg

SEQ ID NO: 40545 - DNA, 24 bp, Homo sapiens
tgcgtggtggctcgaggcgggggt

SEQ ID NO: 40546 - DNA, 21 bp, Homo sapiens
tggctcgaggcgggggtgggg

SEQ ID NO: 40547 - DNA, 16 bp, Homo sapiens
gctcgaggcgggggtg

SEQ ID NO: 40548 - DNA, 18 bp, Homo sapiens
ctcgaggcgggggtgggg

SEQ ID NO: 40549 - DNA, 20 bp, Homo sapiens
cctccctgacctctccgctc

SEQ ID NO: 40550 - DNA, 21 bp, Homo sapiens
cctccctgacctctccgctcc

SEQ ID NO: 40551 - DNA, 22 bp, Homo sapiens
cctccctgacctctccgctccg

SEQ ID NO: 40552 - DNA, 24 bp, Homo sapiens
cctccctgacctctccgctccgca

SEQ ID NO: 40553 - DNA, 25 bp, Homo sapiens
cctccctgacctctccgctccgcac

SEQ ID NO: 40554 - DNA, 26 bp, Homo sapiens
cctccctgacctctccgctccgcaca

SEQ ID NO: 40555 - DNA, 22 bp, Homo sapiens
ctccctgacctctccgctccgc

SEQ ID NO: 40556 - DNA, 28 bp, Homo sapiens
ctccctgacctctccgctccgcacagag

SEQ ID NO: 40557 - DNA, 20 bp, Homo sapiens
tccctgacctctccgctccg

SEQ ID NO: 40558 - DNA, 23 bp, Homo sapiens
tccctgacctctccgctccgcac

SEQ ID NO: 40559 - DNA, 24 bp, Homo sapiens
tccctgacctctccgctccgcaca

SEQ ID NO: 40560 - DNA, 21 bp, Homo sapiens
ccctgacctctccgctccgca

SEQ ID NO: 40561 - DNA, 19 bp, Homo sapiens
cctgacctctccgctccgc

SEQ ID NO: 40562 - DNA, 25 bp, Homo sapiens
cctgacctctccgctccgcacagag

SEQ ID NO: 40563 - DNA, 22 bp, Homo sapiens
ctgacctctccgctccgcacag

SEQ ID NO: 40564 - DNA, 23 bp, Homo sapiens
ctgacctctccgctccgcacaga

SEQ ID NO: 40565 - DNA, 24 bp, Homo sapiens
ctgacctctccgctccgcacagag

SEQ ID NO: 40566 - DNA, 22 bp, Homo sapiens
tgacctctccgctccgcacaga

SEQ ID NO: 40567 - DNA, 23 bp, Homo sapiens
gacctctccgctccgcacagagt

SEQ ID NO: 40568 - DNA, 19 bp, Homo sapiens
acctctccgctccgcacag

SEQ ID NO: 40569 - DNA, 18 bp, Homo sapiens
ctctccgctccgcacaga

SEQ ID NO: 40570 - DNA, 28 bp, Homo sapiens
ttgcagctgcctgggagtgacttcacac

SEQ ID NO: 40571 - DNA, 27 bp, Homo sapiens
ttgcagctgcctgggagtgacttcaca

SEQ ID NO: 40572 - DNA, 23 bp, Homo sapiens
cagctgcctgggagtgacttcac

SEQ ID NO: 40573 - DNA, 26 bp, Homo sapiens
ttgcagctgcctgggagtgacttcac

SEQ ID NO: 40574 - DNA, 22 bp, Homo sapiens
cagctgcctgggagtgacttca

SEQ ID NO: 40575 - DNA, 24 bp, Homo sapiens
tgcagctgcctgggagtgacttca

SEQ ID NO: 40576 - DNA, 25 bp, Homo sapiens
ttgcagctgcctgggagtgacttca

SEQ ID NO: 40577 - DNA, 21 bp, Homo sapiens
cagctgcctgggagtgacttc

SEQ ID NO: 40578 - DNA, 23 bp, Homo sapiens
tgcagctgcctgggagtgacttc

SEQ ID NO: 40579 - DNA, 23 bp, Homo sapiens
ttgcagctgcctgggagtgactt

SEQ ID NO: 40580 - DNA, 21 bp, Homo sapiens
tgcagctgcctgggagtgact

SEQ ID NO: 40581 - DNA, 22 bp, Homo sapiens
ttgcagctgcctgggagtgact

SEQ ID NO: 40582 - DNA, 21 bp, Homo sapiens
ttgcagctgcctgggagtgac

SEQ ID NO: 40583 - DNA, 19 bp, Homo sapiens
tgcagctgcctgggagtga

SEQ ID NO: 40584 - DNA, 20 bp, Homo sapiens
ttgcagctgcctgggagtga

SEQ ID NO: 40585 - DNA, 23 bp, Homo sapiens
ggtcgctctaggcaccgcagcac

SEQ ID NO: 40586 - DNA, 24 bp, Homo sapiens
gggtcgctctaggcaccgcagcac

SEQ ID NO: 40587 - DNA, 22 bp, Homo sapiens
ggtcgctctaggcaccgcagca

SEQ ID NO: 40588 - DNA, 23 bp, Homo sapiens
gggtcgctctaggcaccgcagca

SEQ ID NO: 40589 - DNA, 21 bp, Homo sapiens
ggtcgctctaggcaccgcagc

SEQ ID NO: 40590 - DNA, 22 bp, Homo sapiens
gggtcgctctaggcaccgcagc

SEQ ID NO: 40591 - DNA, 20 bp, Homo sapiens
ggtcgctctaggcaccgcag

SEQ ID NO: 40592 - DNA, 21 bp, Homo sapiens
gggtcgctctaggcaccgcag

SEQ ID NO: 40593 - DNA, 20 bp, Homo sapiens
gggtcgctctaggcaccgca

SEQ ID NO: 40594 - DNA, 17 bp, Homo sapiens
ggtcgctctaggcaccg

SEQ ID NO: 40595 - DNA, 18 bp, Homo sapiens
gggtcgctctaggcaccg

SEQ ID NO: 40596 - DNA, 21 bp, Homo sapiens
taaacaattctaagtgccttg

SEQ ID NO: 40597 - DNA, 20 bp, Homo sapiens
ctgagtgattgatagctatg

SEQ ID NO: 40598 - DNA, 22 bp, Homo sapiens
ctgagtgattgatagctatgtt

SEQ ID NO: 40599 - DNA, 19 bp, Homo sapiens
tgagtgattgatagctatg

SEQ ID NO: 40600 - DNA, 20 bp, Homo sapiens
tgagtgattgatagctatgt

SEQ ID NO: 40601 - DNA, 21 bp, Homo sapiens
tgagtgattgatagctatgtt

SEQ ID NO: 40602 - DNA, 23 bp, Homo sapiens
tgagtgattgatagctatgttca

SEQ ID NO: 40603 - DNA, 21 bp, Homo sapiens
atcttaaagtaaatatgcacc

SEQ ID NO: 40604 - DNA, 22 bp, Homo sapiens
atcttaaagtaaatatgcacca

SEQ ID NO: 40605 - DNA, 23 bp, Homo sapiens
atcttaaagtaaatatgcaccaa

SEQ ID NO: 40606 - DNA, 23 bp, Homo sapiens
tcttaaagtaaatatgcaccaaa

SEQ ID NO: 40607 - DNA, 21 bp, Homo sapiens
ttaaagtaaatatgcaccaaa

SEQ ID NO: 40608 - DNA, 22 bp, Homo sapiens
taaagtaaatatgcaccaaaat

SEQ ID NO: 40609 - DNA, 23 bp, Homo sapiens
taaagtaaatatgcaccaaaatt

SEQ ID NO: 40610 - DNA, 22 bp, Homo sapiens
gcaaaggtaactgtgatttttg

SEQ ID NO: 40611 - DNA, 21 bp, Homo sapiens
caaaggtaactgtgatttttg

SEQ ID NO: 40612 - DNA, 22 bp, Homo sapiens
caaaggtaactgtgatttttgc

SEQ ID NO: 40613 - DNA, 23 bp, Homo sapiens
caaaggtaactgtgatttttgct

SEQ ID NO: 40614 - DNA, 19 bp, Homo sapiens
aaaggtaactgtgattttt

SEQ ID NO: 40615 - DNA, 20 bp, Homo sapiens
aaaggtaactgtgatttttg

SEQ ID NO: 40616 - DNA, 21 bp, Homo sapiens
aaaggtaactgtgatttttgc

SEQ ID NO: 40617 - DNA, 23 bp, Homo sapiens
aaaggtaactgtgatttttgcta

SEQ ID NO: 40618 - DNA, 24 bp, Homo sapiens
aaaggtaactgtgatttttgctat

SEQ ID NO: 40619 - DNA, 25 bp, Homo sapiens
aaaggtaactgtgatttttgctatt

SEQ ID NO: 40620 - DNA, 24 bp, Homo sapiens
aaggtaactgtgatttttgctatt

SEQ ID NO: 40621 - DNA, 27 bp, Homo sapiens
gcgactctgaaaactagaaggtttatg

SEQ ID NO: 40622 - DNA, 22 bp, Homo sapiens
cgactctgaaaactagaaggtt

SEQ ID NO: 40623 - DNA, 23 bp, Homo sapiens
gcgactctgaaaactagaaggtt

SEQ ID NO: 40624 - DNA, 21 bp, Homo sapiens
cgactctgaaaactagaaggt

SEQ ID NO: 40625 - DNA, 22 bp, Homo sapiens
tgcgactctgaaaactagaagg

SEQ ID NO: 40626 - DNA, 26 bp, Homo sapiens
tgatgatacaggtggaggtagaaata

SEQ ID NO: 40627 - DNA, 24 bp, Homo sapiens
tgatgatacaggtggaggtagaaa

SEQ ID NO: 40628 - DNA, 22 bp, Homo sapiens
gatgatacaggtggaggtagaa

SEQ ID NO: 40629 - DNA, 21 bp, Homo sapiens
gatgatacaggtggaggtaga

SEQ ID NO: 40630 - DNA, 22 bp, Homo sapiens
tgatgatacaggtggaggtaga

SEQ ID NO: 40631 - DNA, 23 bp, Homo sapiens
atgatgatacaggtggaggtaga

SEQ ID NO: 40632 - DNA, 20 bp, Homo sapiens
gatgatacaggtggaggtag

SEQ ID NO: 40633 - DNA, 22 bp, Homo sapiens
atgatgatacaggtggaggtag

SEQ ID NO: 40634 - DNA, 20 bp, Homo sapiens
tgatgatacaggtggaggta

SEQ ID NO: 40635 - DNA, 23 bp, Homo sapiens
ctacttctacctgtgttatcata

SEQ ID NO: 40636 - DNA, 21 bp, Homo sapiens
ctacttctacctgtgttatca

SEQ ID NO: 40637 - DNA, 20 bp, Homo sapiens
ctacttctacctgtgttatc

SEQ ID NO: 40638 - DNA, 22 bp, Homo sapiens
gtctacttctacctgtgttatc

SEQ ID NO: 40639 - DNA, 23 bp, Homo sapiens
tgtctacttctacctgtgttatc

SEQ ID NO: 40640 - DNA, 18 bp, Homo sapiens
ctacttctacctgtgtta

SEQ ID NO: 40641 - DNA, 20 bp, Homo sapiens
gtctacttctacctgtgtta

SEQ ID NO: 40642 - DNA, 28 bp, Homo sapiens
tactgcatcaggaactgattggataaga

SEQ ID NO: 40643 - DNA, 27 bp, Homo sapiens
tactgcatcaggaactgattggataag

SEQ ID NO: 40644 - DNA, 23 bp, Homo sapiens
ctgcatcaggaactgattggata

SEQ ID NO: 40645 - DNA, 25 bp, Homo sapiens
tactgcatcaggaactgattggata

SEQ ID NO: 40646 - DNA, 26 bp, Homo sapiens
atactgcatcaggaactgattggata

SEQ ID NO: 40647 - DNA, 23 bp, Homo sapiens
actgcatcaggaactgattggat

SEQ ID NO: 40648 - DNA, 24 bp, Homo sapiens
tactgcatcaggaactgattggat

SEQ ID NO: 40649 - DNA, 22 bp, Homo sapiens
tactgcatcaggaactgattgg

SEQ ID NO: 40650 - DNA, 23 bp, Homo sapiens
atactgcatcaggaactgattgg

SEQ ID NO: 40651 - DNA, 22 bp, Homo sapiens
atactgcatcaggaactgattg

SEQ ID NO: 40652 - DNA, 21 bp, Homo sapiens
atactgcatcaggaactgatt

SEQ ID NO: 40653 - DNA, 19 bp, Homo sapiens
tactgcatcaggaactgat

SEQ ID NO: 40654 - DNA, 17 bp, Homo sapiens
atactgcatcaggaact

SEQ ID NO: 40655 - DNA, 23 bp, Homo sapiens
cacagtggtctctgggattatgc

SEQ ID NO: 40656 - DNA, 21 bp, Homo sapiens
acagtggtctctgggattatg

SEQ ID NO: 40657 - DNA, 22 bp, Homo sapiens
cacagtggtctctgggattatg

SEQ ID NO: 40658 - DNA, 21 bp, Homo sapiens
cacagtggtctctgggattat

SEQ ID NO: 40659 - DNA, 20 bp, Homo sapiens
cacagtggtctctgggatta

SEQ ID NO: 40660 - DNA, 18 bp, Homo sapiens
acagtggtctctgggatt

SEQ ID NO: 40661 - DNA, 19 bp, Homo sapiens
cacagtggtctctgggatt

SEQ ID NO: 40662 - DNA, 20 bp, Homo sapiens
tcacagtggtctctgggatt

SEQ ID NO: 40663 - DNA, 18 bp, Homo sapiens
cacagtggtctctgggat

SEQ ID NO: 40664 - DNA, 19 bp, Homo sapiens
tcacagtggtctctgggat

SEQ ID NO: 40665 - DNA, 16 bp, Homo sapiens
gcaactgtgagatgtt

SEQ ID NO: 40666 - DNA, 21 bp, Homo sapiens
cagctggcaactgtgagatgt

SEQ ID NO: 40667 - DNA, 26 bp, Homo sapiens
taatctcagctggcaactgtgagatg

SEQ ID NO: 40668 - DNA, 25 bp, Homo sapiens
taatctcagctggcaactgtgagat

SEQ ID NO: 40669 - DNA, 24 bp, Homo sapiens
taatctcagctggcaactgtgaga

SEQ ID NO: 40670 - DNA, 23 bp, Homo sapiens
taatctcagctggcaactgtgag

SEQ ID NO: 40671 - DNA, 21 bp, Homo sapiens
aatctcagctggcaactgtga

SEQ ID NO: 40672 - DNA, 21 bp, Homo sapiens
taatctcagctggcaactgtg

SEQ ID NO: 40673 - DNA, 18 bp, Homo sapiens
aatctcagctggcaactg

SEQ ID NO: 40674 - DNA, 19 bp, Homo sapiens
taatctcagctggcaactg

SEQ ID NO: 40675 - DNA, 17 bp, Homo sapiens
taatctcagctggcaac

SEQ ID NO: 40676 - DNA, 22 bp, Homo sapiens
acacttacccgtagagattcta

SEQ ID NO: 40677 - DNA, 20 bp, Homo sapiens
cacttacccgtagagattct

SEQ ID NO: 40678 - DNA, 22 bp, Homo sapiens
cacacttacccgtagagattct

SEQ ID NO: 40679 - DNA, 22 bp, Homo sapiens
acacacttacccgtagagattc

SEQ ID NO: 40680 - DNA, 20 bp, Homo sapiens
cacacttacccgtagagatt

SEQ ID NO: 40681 - DNA, 21 bp, Homo sapiens
acacacttacccgtagagatt

SEQ ID NO: 40682 - DNA, 20 bp, Homo sapiens
acacacttacccgtagagat

SEQ ID NO: 40683 - DNA, 19 bp, Homo sapiens
acacacttacccgtagaga

SEQ ID NO: 40684 - DNA, 26 bp, Homo sapiens
aaatctctgcaggcaaatgtgatgtc

SEQ ID NO: 40685 - DNA, 24 bp, Homo sapiens
aaatctctgcaggcaaatgtgatg

SEQ ID NO: 40686 - DNA, 25 bp, Homo sapiens
aaaatctctgcaggcaaatgtgatg

SEQ ID NO: 40687 - DNA, 24 bp, Homo sapiens
aaaatctctgcaggcaaatgtgat

SEQ ID NO: 40688 - DNA, 23 bp, Homo sapiens
aaaatctctgcaggcaaatgtga

SEQ ID NO: 40689 - DNA, 21 bp, Homo sapiens
aaatctctgcaggcaaatgtg

SEQ ID NO: 40690 - DNA, 20 bp, Homo sapiens
aaatctctgcaggcaaatgt

SEQ ID NO: 40691 - DNA, 18 bp, Homo sapiens
aaatctctgcaggcaaat

SEQ ID NO: 40692 - DNA, 22 bp, Homo sapiens
aaagactctgcaagatgccttg

SEQ ID NO: 40693 - DNA, 21 bp, Homo sapiens
aaagactctgcaagatgcctt

SEQ ID NO: 40694 - DNA, 19 bp, Homo sapiens
aaagactctgcaagatgcc

SEQ ID NO: 40695 - DNA, 21 bp, Homo sapiens
aggctcaatctctggtcctgc

SEQ ID NO: 40696 - DNA, 22 bp, Homo sapiens
aggctcaatctctggtcctgca

SEQ ID NO: 40697 - DNA, 23 bp, Homo sapiens
aggctcaatctctggtcctgcag

SEQ ID NO: 40698 - DNA, 22 bp, Homo sapiens
tcaatctctggtcctgcagcct

SEQ ID NO: 40699 - DNA, 17 bp, Homo sapiens
cgagctgaactagagat

SEQ ID NO: 40700 - DNA, 20 bp, Homo sapiens
ctgaactagagattgggccc

SEQ ID NO: 40701 - DNA, 22 bp, Homo sapiens
ctgaactagagattgggcccag

SEQ ID NO: 40702 - DNA, 23 bp, Homo sapiens
ctgaactagagattgggcccagc

SEQ ID NO: 40703 - DNA, 25 bp, Homo sapiens
ctgaactagagattgggcccagctc

SEQ ID NO: 40704 - DNA, 22 bp, Homo sapiens
tgaactagagattgggcccagc

SEQ ID NO: 40705 - DNA, 28 bp, Homo sapiens
ccaggagagtggattccaggtggtgagg

SEQ ID NO: 40706 - DNA, 20 bp, Homo sapiens
aggagagtggattccaggtg

SEQ ID NO: 40707 - DNA, 21 bp, Homo sapiens
aggagagtggattccaggtgg

SEQ ID NO: 40708 - DNA, 19 bp, Homo sapiens
gattccaggtggtgagggc

SEQ ID NO: 40709 - DNA, 22 bp, Homo sapiens
ggagtggggggtgggacgtaag

SEQ ID NO: 40710 - DNA, 24 bp, Homo sapiens
caggagtggggggtgggacgtaag

SEQ ID NO: 40711 - DNA, 23 bp, Homo sapiens
caggagtggggggtgggacgtaa

SEQ ID NO: 40712 - DNA, 24 bp, Homo sapiens
acaggagtggggggtgggacgtaa

SEQ ID NO: 40713 - DNA, 21 bp, Homo sapiens
aggagtggggggtgggacgta

SEQ ID NO: 40714 - DNA, 22 bp, Homo sapiens
caggagtggggggtgggacgta

SEQ ID NO: 40715 - DNA, 23 bp, Homo sapiens
acaggagtggggggtgggacgta

SEQ ID NO: 40716 - DNA, 23 bp, Homo sapiens
tacgtcccaccccccactcctgt

SEQ ID NO: 40717 - DNA, 22 bp, Homo sapiens
acaggagtggggggtgggacgt

SEQ ID NO: 40718 - DNA, 22 bp, Homo sapiens
acgtcccaccccccactcctgt

SEQ ID NO: 40719 - DNA, 24 bp, Homo sapiens
acgtcccaccccccactcctgttt

SEQ ID NO: 40720 - DNA, 20 bp, Homo sapiens
caggagtggggggtgggacg

SEQ ID NO: 40721 - DNA, 20 bp, Homo sapiens
cgtcccaccccccactcctg

SEQ ID NO: 40722 - DNA, 22 bp, Homo sapiens
cgtcccaccccccactcctgtt

SEQ ID NO: 40723 - DNA, 23 bp, Homo sapiens
cgtcccaccccccactcctgttt

SEQ ID NO: 40724 - DNA, 24 bp, Homo sapiens
cgtcccaccccccactcctgtttc

SEQ ID NO: 40725 - DNA, 18 bp, Homo sapiens
caggagtggggggtggga

SEQ ID NO: 40726 - DNA, 25 bp, Homo sapiens
atgtcccacccccactcctgtttga

SEQ ID NO: 40727 - DNA, 24 bp, Homo sapiens
atgtcccacccccactcctgtttg

SEQ ID NO: 40728 - DNA, 22 bp, Homo sapiens
tgtcccacccccactcctgttt

SEQ ID NO: 40729 - DNA, 23 bp, Homo sapiens
atgtcccacccccactcctgttt

SEQ ID NO: 40730 - DNA, 21 bp, Homo sapiens
tgtcccacccccactcctgtt

SEQ ID NO: 40731 - DNA, 22 bp, Homo sapiens
atgtcccacccccactcctgtt

SEQ ID NO: 40732 - DNA, 19 bp, Homo sapiens
acaggagtgggggtgggac

SEQ ID NO: 40733 - DNA, 20 bp, Homo sapiens
tgtcccacccccactcctgt

SEQ ID NO: 40734 - DNA, 20 bp, Homo sapiens
acaggagtgggggtgggaca

SEQ ID NO: 40735 - DNA, 22 bp, Homo sapiens
tatgtcccacccccactcctgt

SEQ ID NO: 40736 - DNA, 22 bp, Homo sapiens
acaggagtgggggtgggacata

SEQ ID NO: 40737 - DNA, 25 bp, Homo sapiens
acaggagtgggggtgggacataagg

SEQ ID NO: 40738 - DNA, 20 bp, Homo sapiens
caggagtgggggtgggacat

SEQ ID NO: 40739 - DNA, 21 bp, Homo sapiens
caggagtgggggtgggacata

SEQ ID NO: 40740 - DNA, 22 bp, Homo sapiens
caggagtgggggtgggacataa

SEQ ID NO: 40741 - DNA, 25 bp, Homo sapiens
actttaggagaagtaaagtagaact

SEQ ID NO: 40742 - DNA, 20 bp, Homo sapiens
ttaggagaagtaaagtagaa

SEQ ID NO: 40743 - DNA, 19 bp, Homo sapiens
taggagaagtaaagtagaa

SEQ ID NO: 40744 - DNA, 19 bp, Homo sapiens
aggagaagtaaagtagaac

SEQ ID NO: 40745 - DNA, 20 bp, Homo sapiens
aggagaagtaaagtagaact

SEQ ID NO: 40746 - DNA, 21 bp, Homo sapiens
aggagaagtaaagtagaactt

SEQ ID NO: 40747 - DNA, 22 bp, Homo sapiens
gagaagtaaagtagaactttgg

SEQ ID NO: 40748 - DNA, 18 bp, Homo sapiens
agaagtaaagtagaactt

SEQ ID NO: 40749 - DNA, 22 bp, Homo sapiens
tcttcctttgcagagttgaata

SEQ ID NO: 40750 - DNA, 23 bp, Homo sapiens
ttcttcctttgcagagttgaata

SEQ ID NO: 40751 - DNA, 25 bp, Homo sapiens
tcttcttcctttgcagagttgaata

SEQ ID NO: 40752 - DNA, 23 bp, Homo sapiens
aattctgtaaaggaagaagaggt

SEQ ID NO: 40753 - DNA, 23 bp, Homo sapiens
ccaattctgtaaaggaagaagag

SEQ ID NO: 40754 - DNA, 22 bp, Homo sapiens
ccaattctgtaaaggaagaaga

SEQ ID NO: 40755 - DNA, 21 bp, Homo sapiens
ccaattctgtaaaggaagaag

SEQ ID NO: 40756 - DNA, 18 bp, Homo sapiens
atgtccaattctgtaaag

SEQ ID NO: 40757 - DNA, 17 bp, Homo sapiens
atgtccaattctgtaaa

SEQ ID NO: 40758 - DNA, 17 bp, Homo sapiens
tgagggacagatgccag

SEQ ID NO: 40759 - DNA, 18 bp, Homo sapiens
tgagggacagatgccaga

SEQ ID NO: 40760 - DNA, 20 bp, Homo sapiens
tgagggacagatgccagaag

SEQ ID NO: 40761 - DNA, 21 bp, Homo sapiens
tgagggacagatgccagaagc

SEQ ID NO: 40762 - DNA, 23 bp, Homo sapiens
tgagggacagatgccagaagcac

SEQ ID NO: 40763 - DNA, 24 bp, Homo sapiens
tgagggacagatgccagaagcact

SEQ ID NO: 40764 - DNA, 25 bp, Homo sapiens
atttgcatctggcatccgtcacaca

SEQ ID NO: 40765 - DNA, 16 bp, Homo sapiens
catctggcatccgtca

SEQ ID NO: 40766 - DNA, 18 bp, Homo sapiens
catctggcatccgtcaca

SEQ ID NO: 40767 - DNA, 19 bp, Homo sapiens
catctggcatccgtcacac

SEQ ID NO: 40768 - DNA, 20 bp, Homo sapiens
catctggcatccgtcacaca

SEQ ID NO: 40769 - DNA, 21 bp, Homo sapiens
catctggcatccgtcacacag

SEQ ID NO: 40770 - DNA, 23 bp, Homo sapiens
catctggcatccgtcacacagat

SEQ ID NO: 40771 - DNA, 24 bp, Homo sapiens
catctggcatccgtcacacagata

SEQ ID NO: 40772 - DNA, 25 bp, Homo sapiens
catctggcatccgtcacacagataa

SEQ ID NO: 40773 - DNA, 28 bp, Homo sapiens
tctgggcaacaaagtgagacctccgtct

SEQ ID NO: 40774 - DNA, 27 bp, Homo sapiens
tctgggcaacaaagtgagacctccgtc

SEQ ID NO: 40775 - DNA, 26 bp, Homo sapiens
tctgggcaacaaagtgagacctccgt

SEQ ID NO: 40776 - DNA, 25 bp, Homo sapiens
tctgggcaacaaagtgagacctccg

SEQ ID NO: 40777 - DNA, 24 bp, Homo sapiens
cccagttcagaagtgttcctgagt

SEQ ID NO: 40778 - DNA, 21 bp, Homo sapiens
ccagttcagaagtgttcctga

SEQ ID NO: 40779 - DNA, 22 bp, Homo sapiens
ccagttcagaagtgttcctgag

SEQ ID NO: 40780 - DNA, 23 bp, Homo sapiens
ccagttcagaagtgttcctgagt

SEQ ID NO: 40781 - DNA, 26 bp, Homo sapiens
ccagttcagaagtgttcctgagtaac

SEQ ID NO: 40782 - DNA, 19 bp, Homo sapiens
cagttcagaagtgttcctg

SEQ ID NO: 40783 - DNA, 21 bp, Homo sapiens
cagttcagaagtgttcctgag

SEQ ID NO: 40784 - DNA, 23 bp, Homo sapiens
cagttcagaagtgttcctgagta

SEQ ID NO: 40785 - DNA, 24 bp, Homo sapiens
cagttcagaagtgttcctgagtaa

SEQ ID NO: 40786 - DNA, 25 bp, Homo sapiens
cagttcagaagtgttcctgagtaac

SEQ ID NO: 40787 - DNA, 22 bp, Homo sapiens
ctcaggacacttctgaacttgg

SEQ ID NO: 40788 - DNA, 25 bp, Homo sapiens
ctcaggacacttctgaacttggacc

SEQ ID NO: 40789 - DNA, 20 bp, Homo sapiens
tcaggacacttctgaacttg

SEQ ID NO: 40790 - DNA, 21 bp, Homo sapiens
tcaggacacttctgaacttgg

SEQ ID NO: 40791 - DNA, 23 bp, Homo sapiens
tcaggacacttctgaacttggac

SEQ ID NO: 40792 - DNA, 24 bp, Homo sapiens
tcaggacacttctgaacttggacc

SEQ ID NO: 40793 - DNA, 21 bp, Homo sapiens
caggacacttctgaacttgga

SEQ ID NO: 40794 - DNA, 21 bp, Homo sapiens
ctggatactcagtcatggtca

SEQ ID NO: 40795 - DNA, 20 bp, Homo sapiens
ctggatactcagtcatggtc

SEQ ID NO: 40796 - DNA, 19 bp, Homo sapiens
ctggatactcagtcatggt

SEQ ID NO: 40797 - DNA, 18 bp, Homo sapiens
ctggatactcagtcatgg

SEQ ID NO: 40798 - DNA, 19 bp, Homo sapiens
tgccggccaaggctctggg

SEQ ID NO: 40799 - DNA, 25 bp, Homo sapiens
taggagggaatagtaaaagcagtaa

SEQ ID NO: 40800 - DNA, 21 bp, Homo sapiens
gagggaatagtaaaagcagta

SEQ ID NO: 40801 - DNA, 23 bp, Homo sapiens
aggagggaatagtaaaagcagta

SEQ ID NO: 40802 - DNA, 22 bp, Homo sapiens
aggagggaatagtaaaagcagt

SEQ ID NO: 40803 - DNA, 23 bp, Homo sapiens
taggagggaatagtaaaagcagt

SEQ ID NO: 40804 - DNA, 21 bp, Homo sapiens
taggagggaatagtaaaagca

SEQ ID NO: 40805 - DNA, 20 bp, Homo sapiens
taggagggaatagtaaaagc

SEQ ID NO: 40806 - DNA, 19 bp, Homo sapiens
gctcacacagagggatgag

SEQ ID NO: 40807 - DNA, 24 bp, Homo sapiens
cccttgagcctgatccctagcact

SEQ ID NO: 40808 - DNA, 22 bp, Homo sapiens
cccttgagcctgatccctagca

SEQ ID NO: 40809 - DNA, 23 bp, Homo sapiens
acccttgagcctgatccctagca

SEQ ID NO: 40810 - DNA, 21 bp, Homo sapiens
cccttgagcctgatccctagc

SEQ ID NO: 40811 - DNA, 21 bp, Homo sapiens
acccttgagcctgatccctag

SEQ ID NO: 40812 - DNA, 20 bp, Homo sapiens
acccttgagcctgatcccta

SEQ ID NO: 40813 - DNA, 19 bp, Homo sapiens
acccttgagcctgatccct

SEQ ID NO: 40814 - DNA, 23 bp, Homo sapiens
cctgacccttgagcctgatccct

SEQ ID NO: 40815 - DNA, 20 bp, Homo sapiens
cctgacccttgagcctgatc

SEQ ID NO: 40816 - DNA, 21 bp, Homo sapiens
tttgggcaggacaggcagaag

SEQ ID NO: 40817 - DNA, 22 bp, Homo sapiens
tttgggcaggacaggcagaagt

SEQ ID NO: 40818 - DNA, 18 bp, Homo sapiens
ttgggcaggacaggcaga

SEQ ID NO: 40819 - DNA, 20 bp, Homo sapiens
ttgggcaggacaggcagaag

SEQ ID NO: 40820 - DNA, 21 bp, Homo sapiens
ttgggcaggacaggcagaagt

SEQ ID NO: 40821 - DNA, 23 bp, Homo sapiens
ttgggcaggacaggcagaagtgg

SEQ ID NO: 40822 - DNA, 19 bp, Homo sapiens
tgggcaggacaggcagaag

SEQ ID NO: 40823 - DNA, 20 bp, Homo sapiens
gcaggacaggcagaagtgga

SEQ ID NO: 40824 - DNA, 22 bp, Homo sapiens
catcagggcttgtggaatggga

SEQ ID NO: 40825 - DNA, 23 bp, Homo sapiens
catcagggcttgtggaatgggaa

SEQ ID NO: 40826 - DNA, 24 bp, Homo sapiens
catcagggcttgtggaatgggaag

SEQ ID NO: 40827 - DNA, 19 bp, Homo sapiens
atcagggcttgtggaatgg

SEQ ID NO: 40828 - DNA, 20 bp, Homo sapiens
atcagggcttgtggaatggg

SEQ ID NO: 40829 - DNA, 21 bp, Homo sapiens
atcagggcttgtggaatggga

SEQ ID NO: 40830 - DNA, 22 bp, Homo sapiens
atcagggcttgtggaatgggaa

SEQ ID NO: 40831 - DNA, 24 bp, Homo sapiens
atcagggcttgtggaatgggaagg

SEQ ID NO: 40832 - DNA, 20 bp, Homo sapiens
ttccccttctgcaggcctgc

SEQ ID NO: 40833 - DNA, 23 bp, Homo sapiens
ttccccttctgcaggcctgctgg

SEQ ID NO: 40834 - DNA, 19 bp, Homo sapiens
tccccttctgcaggcctgc

SEQ ID NO: 40835 - DNA, 20 bp, Homo sapiens
tccccttctgcaggcctgct

SEQ ID NO: 40836 - DNA, 21 bp, Homo sapiens
tccccttctgcaggcctgctg

SEQ ID NO: 40837 - DNA, 23 bp, Homo sapiens
tccccttctgcaggcctgctggg

SEQ ID NO: 40838 - DNA, 24 bp, Homo sapiens
tccccttctgcaggcctgctgggt

SEQ ID NO: 40839 - DNA, 25 bp, Homo sapiens
tccccttctgcaggcctgctgggtg

SEQ ID NO: 40840 - DNA, 26 bp, Homo sapiens
tccccttctgcaggcctgctgggtgt

SEQ ID NO: 40841 - DNA, 16 bp, Homo sapiens
ggcctgctgggtgtgg

SEQ ID NO: 40842 - DNA, 24 bp, Homo sapiens
aaaagtaattgtggattttgctat

SEQ ID NO: 40843 - DNA, 23 bp, Homo sapiens
aaaagtaattgtggattttgcta

SEQ ID NO: 40844 - DNA, 20 bp, Homo sapiens
gcactggacttggaggcaga

SEQ ID NO: 40845 - DNA, 23 bp, Homo sapiens
cactggacttggaggcagaaaga

SEQ ID NO: 40846 - DNA, 20 bp, Homo sapiens
actggacttggaggcagaaa

SEQ ID NO: 40847 - DNA, 21 bp, Homo sapiens
actggacttggaggcagaaag

SEQ ID NO: 40848 - DNA, 22 bp, Homo sapiens
actggacttggaggcagaaaga

SEQ ID NO: 40849 - DNA, 23 bp, Homo sapiens
actggacttggaggcagaaagac

SEQ ID NO: 40850 - DNA, 24 bp, Homo sapiens
actggacttggaggcagaaagacc

SEQ ID NO: 40851 - DNA, 25 bp, Homo sapiens
actggacttggaggcagaaagaccc

SEQ ID NO: 40852 - DNA, 16 bp, Homo sapiens
ggaggcagaaagaccc

SEQ ID NO: 40853 - DNA, 24 bp, Homo sapiens
aggcagcggggtgtagtggataga

SEQ ID NO: 40854 - DNA, 23 bp, Homo sapiens
aggcagcggggtgtagtggatag

SEQ ID NO: 40855 - DNA, 21 bp, Homo sapiens
aggcagcggggtgtagtggat

SEQ ID NO: 40856 - DNA, 20 bp, Homo sapiens
aggcagcggggtgtagtgga

SEQ ID NO: 40857 - DNA, 19 bp, Homo sapiens
aggcagcggggtgtagtgg

SEQ ID NO: 40858 - DNA, 18 bp, Homo sapiens
aggcagcggggtgtagtg

SEQ ID NO: 40859 - DNA, 27 bp, Homo sapiens
tccattacactaccctgcctcttctcc

SEQ ID NO: 40860 - DNA, 24 bp, Homo sapiens
cattacactaccctgcctcttctc

SEQ ID NO: 40861 - DNA, 26 bp, Homo sapiens
tccattacactaccctgcctcttctc

SEQ ID NO: 40862 - DNA, 27 bp, Homo sapiens
ctccattacactaccctgcctcttctc

SEQ ID NO: 40863 - DNA, 24 bp, Homo sapiens
tccattacactaccctgcctcttc

SEQ ID NO: 40864 - DNA, 24 bp, Homo sapiens
ctccattacactaccctgcctctt

SEQ ID NO: 40865 - DNA, 23 bp, Homo sapiens
ctccattacactaccctgcctct

SEQ ID NO: 40866 - DNA, 22 bp, Homo sapiens
ctccattacactaccctgcctc

SEQ ID NO: 40867 - DNA, 21 bp, Homo sapiens
ctccattacactaccctgcct

SEQ ID NO: 40868 - DNA, 22 bp, Homo sapiens
tctccattacactaccctgcct

SEQ ID NO: 40869 - DNA, 20 bp, Homo sapiens
tctccattacactaccctgc

SEQ ID NO: 40870 - DNA, 18 bp, Homo sapiens
ctccattacactaccctg

SEQ ID NO: 40871 - DNA, 17 bp, Homo sapiens
tctccattacactaccc

SEQ ID NO: 40872 - DNA, 20 bp, Homo sapiens
agattgtttcttttgccgtg

SEQ ID NO: 40873 - DNA, 21 bp, Homo sapiens
agattgtttcttttgccgtgc

SEQ ID NO: 40874 - DNA, 22 bp, Homo sapiens
cacggcaaaagaaacaatccag

SEQ ID NO: 40875 - DNA, 21 bp, Homo sapiens
agtatgttcttccaggacaga

SEQ ID NO: 40876 - DNA, 24 bp, Homo sapiens
tggtccatttccctgccattccct

SEQ ID NO: 40877 - DNA, 21 bp, Homo sapiens
ccatttccctgccattccctt

SEQ ID NO: 40878 - DNA, 22 bp, Homo sapiens
ccatttccctgccattcccttg

SEQ ID NO: 40879 - DNA, 23 bp, Homo sapiens
ccatttccctgccattcccttgg

SEQ ID NO: 40880 - DNA, 24 bp, Homo sapiens
ccatttccctgccattcccttggc

SEQ ID NO: 40881 - DNA, 21 bp, Homo sapiens
catttccctgccattcccttg

SEQ ID NO: 40882 - DNA, 22 bp, Homo sapiens
catttccctgccattcccttgg

SEQ ID NO: 40883 - DNA, 23 bp, Homo sapiens
catttccctgccattcccttggc

SEQ ID NO: 40884 - DNA, 24 bp, Homo sapiens
catttccctgccattcccttggct

SEQ ID NO: 40885 - DNA, 25 bp, Homo sapiens
catttccctgccattcccttggctt

SEQ ID NO: 40886 - DNA, 21 bp, Homo sapiens
atttccctgccattcccttgg

SEQ ID NO: 40887 - DNA, 24 bp, Homo sapiens
ccagggctggcagtgacatgggtc

SEQ ID NO: 40888 - DNA, 19 bp, Homo sapiens
cagggctggcagtgacatg

SEQ ID NO: 40889 - DNA, 20 bp, Homo sapiens
cagggctggcagtgacatgg

SEQ ID NO: 40890 - DNA, 21 bp, Homo sapiens
cagggctggcagtgacatggg

SEQ ID NO: 40891 - DNA, 23 bp, Homo sapiens
cagggctggcagtgacatgggtc

SEQ ID NO: 40892 - DNA, 24 bp, Homo sapiens
cagggctggcagtgacatgggtca

SEQ ID NO: 40893 - DNA, 25 bp, Homo sapiens
cagggctggcagtgacatgggtcaa

SEQ ID NO: 40894 - DNA, 21 bp, Homo sapiens
agggctggcagtgacatgggt

SEQ ID NO: 40895 - DNA, 22 bp, Homo sapiens
agggctggcagtgacatgggtc

SEQ ID NO: 40896 - DNA, 21 bp, Homo sapiens
agtggcagagtatagacacaa

SEQ ID NO: 40897 - DNA, 23 bp, Homo sapiens
aaagtggcagagtatagacacaa

SEQ ID NO: 40898 - DNA, 22 bp, Homo sapiens
aaagtggcagagtatagacaca

SEQ ID NO: 40899 - DNA, 23 bp, Homo sapiens
taaagtggcagagtatagacaca

SEQ ID NO: 40900 - DNA, 20 bp, Homo sapiens
aaagtggcagagtatagaca

SEQ ID NO: 40901 - DNA, 21 bp, Homo sapiens
taaagtggcagagtatagaca

SEQ ID NO: 40902 - DNA, 20 bp, Homo sapiens
taaagtggcagagtatagac

SEQ ID NO: 40903 - DNA, 19 bp, Homo sapiens
taaagtggcagagtataga

SEQ ID NO: 40904 - DNA, 21 bp, Homo sapiens
tctatactctgtcactttact

SEQ ID NO: 40905 - DNA, 22 bp, Homo sapiens
gtctatactctgtcactttact

SEQ ID NO: 40906 - DNA, 23 bp, Homo sapiens
tgtctatactctgtcactttact

SEQ ID NO: 40907 - DNA, 21 bp, Homo sapiens
tgtctatactctgtcacttta

SEQ ID NO: 40908 - DNA, 20 bp, Homo sapiens
tgtctatactctgtcacttt

SEQ ID NO: 40909 - DNA, 19 bp, Homo sapiens
tgtctatactctgtcactt

SEQ ID NO: 40910 - DNA, 21 bp, Homo sapiens
tgtggtgggggctgttgtttg

SEQ ID NO: 40911 - DNA, 23 bp, Homo sapiens
cagaggggagataggttcctgtg

SEQ ID NO: 40912 - DNA, 27 bp, Homo sapiens
tggtccagaggggagataggttcctgt

SEQ ID NO: 40913 - DNA, 27 bp, Homo sapiens
ttggtccagaggggagataggttcctg

SEQ ID NO: 40914 - DNA, 28 bp, Homo sapiens
attggtccagaggggagataggttcctg

SEQ ID NO: 40915 - DNA, 22 bp, Homo sapiens
tggtccagaggggagataggtt

SEQ ID NO: 40916 - DNA, 24 bp, Homo sapiens
attggtccagaggggagataggtt

SEQ ID NO: 40917 - DNA, 27 bp, Homo sapiens
atcattggtccagaggggagataggtt

SEQ ID NO: 40918 - DNA, 19 bp, Homo sapiens
gtccagaggggagataggt

SEQ ID NO: 40919 - DNA, 20 bp, Homo sapiens
attggtccagaggggagata

SEQ ID NO: 40920 - DNA, 18 bp, Homo sapiens
gtagcaccttgcaggata

SEQ ID NO: 40921 - DNA, 19 bp, Homo sapiens
gtagcaccttgcaggataa

SEQ ID NO: 40922 - DNA, 20 bp, Homo sapiens
gtagcaccttgcaggataag

SEQ ID NO: 40923 - DNA, 23 bp, Homo sapiens
gtagcaccttgcaggataaggtc

SEQ ID NO: 40924 - DNA, 21 bp, Homo sapiens
tagcaccttgcaggataaggt

SEQ ID NO: 40925 - DNA, 22 bp, Homo sapiens
tagcaccttgcaggataaggtc

SEQ ID NO: 40926 - DNA, 16 bp, Homo sapiens
aggggctgggggtgtg

SEQ ID NO: 40927 - DNA, 28 bp, Homo sapiens
gggctgggggtgtggggagagagagtgc

SEQ ID NO: 40928 - DNA, 23 bp, Homo sapiens
ggctgggggtgtggggagagaga

SEQ ID NO: 40929 - DNA, 21 bp, Homo sapiens
gctgggggtgtggggagagag

SEQ ID NO: 40930 - DNA, 19 bp, Homo sapiens
ctgggggtgtggggagaga

SEQ ID NO: 40931 - DNA, 20 bp, Homo sapiens
ctgggggtgtggggagagag

SEQ ID NO: 40932 - DNA, 21 bp, Homo sapiens
ctgggggtgtggggagagaga

SEQ ID NO: 40933 - DNA, 22 bp, Homo sapiens
ctgggggtgtggggagagagag

SEQ ID NO: 40934 - DNA, 23 bp, Homo sapiens
ctgggggtgtggggagagagagt

SEQ ID NO: 40935 - DNA, 24 bp, Homo sapiens
ctgggggtgtggggagagagagtg

SEQ ID NO: 40936 - DNA, 26 bp, Homo sapiens
ctgggggtgtggggagagagagtgca

SEQ ID NO: 40937 - DNA, 20 bp, Homo sapiens
tgggggtgtggggagagaga

SEQ ID NO: 40938 - DNA, 22 bp, Homo sapiens
tgggggtgtggggagagagagt

SEQ ID NO: 40939 - DNA, 21 bp, Homo sapiens
tgtggggagagagagtgcaca

SEQ ID NO: 40940 - DNA, 19 bp, Homo sapiens
tggggagagagagtgcaca

SEQ ID NO: 40941 - DNA, 23 bp, Homo sapiens
tctctctctcccacttccctgca

SEQ ID NO: 40942 - DNA, 20 bp, Homo sapiens
ctctctctcccacttccctg

SEQ ID NO: 40943 - DNA, 21 bp, Homo sapiens
ctctctctcccacttccctgc

SEQ ID NO: 40944 - DNA, 22 bp, Homo sapiens
ctctctctcccacttccctgca

SEQ ID NO: 40945 - DNA, 23 bp, Homo sapiens
ctctctctcccacttccctgcag

SEQ ID NO: 40946 - DNA, 24 bp, Homo sapiens
ctctctctcccacttccctgcagg

SEQ ID NO: 40947 - DNA, 24 bp, Homo sapiens
tctctctcccacttccctgcagga

SEQ ID NO: 40948 - DNA, 17 bp, Homo sapiens
aatttggtttctgaggc

SEQ ID NO: 40949 - DNA, 18 bp, Homo sapiens
aatttggtttctgaggca

SEQ ID NO: 40950 - DNA, 21 bp, Homo sapiens
aatttggtttctgaggcactt

SEQ ID NO: 40951 - DNA, 22 bp, Homo sapiens
aatttggtttctgaggcactta

SEQ ID NO: 40952 - DNA, 21 bp, Homo sapiens
ttggtttctgaggcacttagt

SEQ ID NO: 40953 - DNA, 24 bp, Homo sapiens
ttggtttctgaggcacttagtagg

SEQ ID NO: 40954 - DNA, 20 bp, Homo sapiens
tgactgcctcactgaccact

SEQ ID NO: 40955 - DNA, 23 bp, Homo sapiens
tgactgcctcactgaccacttcc

SEQ ID NO: 40956 - DNA, 21 bp, Homo sapiens
actgcctcactgaccacttcc

SEQ ID NO: 40957 - DNA, 23 bp, Homo sapiens
tagacctgaggttgtgcatttct

SEQ ID NO: 40958 - DNA, 21 bp, Homo sapiens
agacctgaggttgtgcatttc

SEQ ID NO: 40959 - DNA, 22 bp, Homo sapiens
agacctgaggttgtgcatttct

SEQ ID NO: 40960 - DNA, 24 bp, Homo sapiens
agacctgaggttgtgcatttctaa

SEQ ID NO: 40961 - DNA, 16 bp, Homo sapiens
gacctgaggttgtgca

SEQ ID NO: 40962 - DNA, 21 bp, Homo sapiens
gacctgaggttgtgcatttct

SEQ ID NO: 40963 - DNA, 22 bp, Homo sapiens
gacctgaggttgtgcatttcta

SEQ ID NO: 40964 - DNA, 23 bp, Homo sapiens
gacctgaggttgtgcatttctaa

SEQ ID NO: 40965 - DNA, 19 bp, Homo sapiens
acctgaggttgtgcatttc

SEQ ID NO: 40966 - DNA, 20 bp, Homo sapiens
acctgaggttgtgcatttct

SEQ ID NO: 40967 - DNA, 21 bp, Homo sapiens
acctgaggttgtgcatttcta

SEQ ID NO: 40968 - DNA, 23 bp, Homo sapiens
acctgaggttgtgcatttctaac

SEQ ID NO: 40969 - DNA, 24 bp, Homo sapiens
aatccacgctgagcttggcatctg

SEQ ID NO: 40970 - DNA, 23 bp, Homo sapiens
aatccacgctgagcttggcatct

SEQ ID NO: 40971 - DNA, 21 bp, Homo sapiens
atccacgctgagcttggcatc

SEQ ID NO: 40972 - DNA, 21 bp, Homo sapiens
aatccacgctgagcttggcat

SEQ ID NO: 40973 - DNA, 20 bp, Homo sapiens
aatccacgctgagcttggca

SEQ ID NO: 40974 - DNA, 21 bp, Homo sapiens
caaaccaatccacgctgagct

SEQ ID NO: 40975 - DNA, 18 bp, Homo sapiens
caaaccaatccacgctga

SEQ ID NO: 40976 - DNA, 26 bp, Homo sapiens
cgcgctgacccgccttctccgcagct

SEQ ID NO: 40977 - DNA, 27 bp, Homo sapiens
ccgcgctgacccgccttctccgcagct

SEQ ID NO: 40978 - DNA, 23 bp, Homo sapiens
cgctgacccgccttctccgcagc

SEQ ID NO: 40979 - DNA, 25 bp, Homo sapiens
cgcgctgacccgccttctccgcagc

SEQ ID NO: 40980 - DNA, 26 bp, Homo sapiens
ccgcgctgacccgccttctccgcagc

SEQ ID NO: 40981 - DNA, 22 bp, Homo sapiens
cgctgacccgccttctccgcag

SEQ ID NO: 40982 - DNA, 23 bp, Homo sapiens
gcgctgacccgccttctccgcag

SEQ ID NO: 40983 - DNA, 21 bp, Homo sapiens
cgctgacccgccttctccgca

SEQ ID NO: 40984 - DNA, 23 bp, Homo sapiens
cgcgctgacccgccttctccgca

SEQ ID NO: 40985 - DNA, 21 bp, Homo sapiens
gcgctgacccgccttctccgc

SEQ ID NO: 40986 - DNA, 23 bp, Homo sapiens
ccgcgctgacccgccttctccgc

SEQ ID NO: 40987 - DNA, 17 bp, Homo sapiens
ccccgcgctgacccgcc

SEQ ID NO: 40988 - DNA, 16 bp, Homo sapiens
ggccccgcgctgaccc

SEQ ID NO: 40989 - DNA, 22 bp, Homo sapiens
gaggtgtggagtcagcatgggg

SEQ ID NO: 40990 - DNA, 21 bp, Homo sapiens
gaggtgtggagtcagcatggg

SEQ ID NO: 40991 - DNA, 25 bp, Homo sapiens
tggggaggtgtggagtcagcatggg

SEQ ID NO: 40992 - DNA, 22 bp, Homo sapiens
gggaggtgtggagtcagcatgg

SEQ ID NO: 40993 - DNA, 24 bp, Homo sapiens
tggggaggtgtggagtcagcatgg

SEQ ID NO: 40994 - DNA, 25 bp, Homo sapiens
atggggaggtgtggagtcagcatgg

SEQ ID NO: 40995 - DNA, 26 bp, Homo sapiens
catggggaggtgtggagtcagcatgg

SEQ ID NO: 40996 - DNA, 22 bp, Homo sapiens
ggggaggtgtggagtcagcatg

SEQ ID NO: 40997 - DNA, 23 bp, Homo sapiens
tggggaggtgtggagtcagcatg

SEQ ID NO: 40998 - DNA, 24 bp, Homo sapiens
atggggaggtgtggagtcagcatg

SEQ ID NO: 40999 - DNA, 23 bp, Homo sapiens
atggggaggtgtggagtcagcat

SEQ ID NO: 41000 - DNA, 24 bp, Homo sapiens
catggggaggtgtggagtcagcat

SEQ ID NO: 41001 - DNA, 21 bp, Homo sapiens
tggggaggtgtggagtcagca

SEQ ID NO: 41002 - DNA, 23 bp, Homo sapiens
catggggaggtgtggagtcagca

SEQ ID NO: 41003 - DNA, 20 bp, Homo sapiens
tggggaggtgtggagtcagc

SEQ ID NO: 41004 - DNA, 19 bp, Homo sapiens
tggggaggtgtggagtcag

SEQ ID NO: 41005 - DNA, 24 bp, Homo sapiens
tgccctgagacttttgctctaata

SEQ ID NO: 41006 - DNA, 23 bp, Homo sapiens
tgccctgagacttttgctctaat

SEQ ID NO: 41007 - DNA, 22 bp, Homo sapiens
tgccctgagacttttgctctaa

SEQ ID NO: 41008 - DNA, 21 bp, Homo sapiens
tgccctgagacttttgctcta

SEQ ID NO: 41009 - DNA, 20 bp, Homo sapiens
tgccctgagacttttgctct

SEQ ID NO: 41010 - DNA, 28 bp, Homo sapiens
gtcaataggaaagaggtgggacctcctg

SEQ ID NO: 41011 - DNA, 21 bp, Homo sapiens
tcaataggaaagaggtgggac

SEQ ID NO: 41012 - DNA, 22 bp, Homo sapiens
tcaataggaaagaggtgggacc

SEQ ID NO: 41013 - DNA, 24 bp, Homo sapiens
tcaataggaaagaggtgggacctc

SEQ ID NO: 41014 - DNA, 25 bp, Homo sapiens
tcaataggaaagaggtgggacctcc

SEQ ID NO: 41015 - DNA, 20 bp, Homo sapiens
caataggaaagaggtgggac

SEQ ID NO: 41016 - DNA, 21 bp, Homo sapiens
caataggaaagaggtgggacc

SEQ ID NO: 41017 - DNA, 23 bp, Homo sapiens
caataggaaagaggtgggacctc

SEQ ID NO: 41018 - DNA, 24 bp, Homo sapiens
caataggaaagaggtgggacctcc

SEQ ID NO: 41019 - DNA, 25 bp, Homo sapiens
caataggaaagaggtgggacctcct

SEQ ID NO: 41020 - DNA, 20 bp, Homo sapiens
aataggaaagaggtgggacc

SEQ ID NO: 41021 - DNA, 21 bp, Homo sapiens
aataggaaagaggtgggacct

SEQ ID NO: 41022 - DNA, 19 bp, Homo sapiens
ctcccctctctttcctgtt

SEQ ID NO: 41023 - DNA, 20 bp, Homo sapiens
ctcccctctctttcctgttc

SEQ ID NO: 41024 - DNA, 21 bp, Homo sapiens
ctcccctctctttcctgttca

SEQ ID NO: 41025 - DNA, 23 bp, Homo sapiens
ctcccctctctttcctgttcagt

SEQ ID NO: 41026 - DNA, 25 bp, Homo sapiens
ctcccctctctttcctgttcagttt

SEQ ID NO: 41027 - DNA, 22 bp, Homo sapiens
tcccctctctttcctgttcagt

SEQ ID NO: 41028 - DNA, 21 bp, Homo sapiens
atcatcccattatgctaagtc

SEQ ID NO: 41029 - DNA, 22 bp, Homo sapiens
taggccatcatcccattatgct

SEQ ID NO: 41030 - DNA, 21 bp, Homo sapiens
taggccatcatcccattatgc

SEQ ID NO: 41031 - DNA, 21 bp, Homo sapiens
tttaggccatcatcccattat

SEQ ID NO: 41032 - DNA, 24 bp, Homo sapiens
ccgtctcttctgttccccaggatc

SEQ ID NO: 41033 - DNA, 25 bp, Homo sapiens
accgtctcttctgttccccaggatc

SEQ ID NO: 41034 - DNA, 23 bp, Homo sapiens
ccgtctcttctgttccccaggat

SEQ ID NO: 41035 - DNA, 24 bp, Homo sapiens
accgtctcttctgttccccaggat

SEQ ID NO: 41036 - DNA, 22 bp, Homo sapiens
ccgtctcttctgttccccagga

SEQ ID NO: 41037 - DNA, 23 bp, Homo sapiens
accgtctcttctgttccccagga

SEQ ID NO: 41038 - DNA, 23 bp, Homo sapiens
gagcaccgtctcttctgttcccc

SEQ ID NO: 41039 - DNA, 20 bp, Homo sapiens
ctgagcaccgtctcttctgt

SEQ ID NO: 41040 - DNA, 19 bp, Homo sapiens
tgagggtctgtgctgtctc

SEQ ID NO: 41041 - DNA, 25 bp, Homo sapiens
tgggagccatgagggtctgtgctgt

SEQ ID NO: 41042 - DNA, 24 bp, Homo sapiens
tgggagccatgagggtctgtgctg

SEQ ID NO: 41043 - DNA, 23 bp, Homo sapiens
tgggagccatgagggtctgtgct

SEQ ID NO: 41044 - DNA, 24 bp, Homo sapiens
gtgggagccatgagggtctgtgct

SEQ ID NO: 41045 - DNA, 23 bp, Homo sapiens
gtgggagccatgagggtctgtgc

SEQ ID NO: 41046 - DNA, 24 bp, Homo sapiens
ggtgggagccatgagggtctgtgc

SEQ ID NO: 41047 - DNA, 25 bp, Homo sapiens
tggtgggagccatgagggtctgtgc

SEQ ID NO: 41048 - DNA, 21 bp, Homo sapiens
tgggagccatgagggtctgtg

SEQ ID NO: 41049 - DNA, 21 bp, Homo sapiens
gtgggagccatgagggtctgt

SEQ ID NO: 41050 - DNA, 19 bp, Homo sapiens
tgggagccatgagggtctg

SEQ ID NO: 41051 - DNA, 18 bp, Homo sapiens
tgggagccatgagggtct

SEQ ID NO: 41052 - DNA, 19 bp, Homo sapiens
gtgggagccatgagggtct

SEQ ID NO: 41053 - DNA, 24 bp, Homo sapiens
aggattacggaccagctaagggag

SEQ ID NO: 41054 - DNA, 24 bp, Homo sapiens
ttacggaccagctaagggaggcat

SEQ ID NO: 41055 - DNA, 25 bp, Homo sapiens
ttacggaccagctaagggaggcatt

SEQ ID NO: 41056 - DNA, 23 bp, Homo sapiens
tacggaccagctaagggaggcat

SEQ ID NO: 41057 - DNA, 27 bp, Homo sapiens
tacggaccagctaagggaggcattagg

SEQ ID NO: 41058 - DNA, 23 bp, Homo sapiens
acggaccagctaagggaggcatt

SEQ ID NO: 41059 - DNA, 23 bp, Homo sapiens
gagagattggtagaaatcaggtg

SEQ ID NO: 41060 - DNA, 24 bp, Homo sapiens
tggggagagattggtagaaatcag

SEQ ID NO: 41061 - DNA, 17 bp, Homo sapiens
agagattggtagaaatc

SEQ ID NO: 41062 - DNA, 25 bp, Homo sapiens
tcagggagtcaggggagggcagaaa

SEQ ID NO: 41063 - DNA, 24 bp, Homo sapiens
tcagggagtcaggggagggcagaa

SEQ ID NO: 41064 - DNA, 23 bp, Homo sapiens
tcagggagtcaggggagggcaga

SEQ ID NO: 41065 - DNA, 22 bp, Homo sapiens
tcagggagtcaggggagggcag

SEQ ID NO: 41066 - DNA, 21 bp, Homo sapiens
tcagggagtcaggggagggca

SEQ ID NO: 41067 - DNA, 21 bp, Homo sapiens
tatgatggataaaagactaca

SEQ ID NO: 41068 - DNA, 22 bp, Homo sapiens
atatgatggataaaagactaca

SEQ ID NO: 41069 - DNA, 24 bp, Homo sapiens
aaatatgatggataaaagactaca

SEQ ID NO: 41070 - DNA, 21 bp, Homo sapiens
atatgatggataaaagactac

SEQ ID NO: 41071 - DNA, 19 bp, Homo sapiens
gcagagaacaaaggactca

SEQ ID NO: 41072 - DNA, 22 bp, Homo sapiens
gcagagaacaaaggactcagta

SEQ ID NO: 41073 - DNA, 21 bp, Homo sapiens
cagagaacaaaggactcagta

SEQ ID NO: 41074 - DNA, 22 bp, Homo sapiens
cagagaacaaaggactcagtaa

SEQ ID NO: 41075 - DNA, 16 bp, Homo sapiens
gtaattaggttgacat

SEQ ID NO: 41076 - DNA, 18 bp, Homo sapiens
ggttgacatacgtttccc

SEQ ID NO: 41077 - DNA, 19 bp, Homo sapiens
tagcagcacatcatggttt

SEQ ID NO: 41078 - DNA, 20 bp, Homo sapiens
tagcagcacatcatggttta

SEQ ID NO: 41079 - DNA, 21 bp, Homo sapiens
tagcagcacatcatggtttac

SEQ ID NO: 41080 - DNA, 23 bp, Homo sapiens
tagcagcacatcatggtttacat

SEQ ID NO: 41081 - DNA, 24 bp, Homo sapiens
tagcagcacatcatggtttacatg

SEQ ID NO: 41082 - DNA, 16 bp, Homo sapiens
cagcacatcatggttt

SEQ ID NO: 41083 - DNA, 17 bp, Homo sapiens
cagcacatcatggttta

SEQ ID NO: 41084 - DNA, 18 bp, Homo sapiens
cagcacatcatggtttac

SEQ ID NO: 41085 - DNA, 19 bp, Homo sapiens
cagcacatcatggtttaca

SEQ ID NO: 41086 - DNA, 20 bp, Homo sapiens
cagcacatcatggtttacat

SEQ ID NO: 41087 - DNA, 21 bp, Homo sapiens
cagcacatcatggtttacatg

SEQ ID NO: 41088 - DNA, 24 bp, Homo sapiens
cagcacatcatggtttacatgcta

SEQ ID NO: 41089 - DNA, 18 bp, Homo sapiens
aagatgcgaatcattatt

SEQ ID NO: 41090 - DNA, 18 bp, Homo sapiens
cgaatcattatttgctgc

SEQ ID NO: 41091 - DNA, 19 bp, Homo sapiens
cgaatcattatttgctgct

SEQ ID NO: 41092 - DNA, 20 bp, Homo sapiens
cgaatcattatttgctgctc

SEQ ID NO: 41093 - DNA, 21 bp, Homo sapiens
cgaatcattatttgctgctct

SEQ ID NO: 41094 - DNA, 23 bp, Homo sapiens
cgaatcattatttgctgctctag

SEQ ID NO: 41095 - DNA, 25 bp, Homo sapiens
cgaatcattatttgctgctctagaa

SEQ ID NO: 41096 - DNA, 21 bp, Homo sapiens
ctagcagcacgtaaatattgg

SEQ ID NO: 41097 - DNA, 23 bp, Homo sapiens
ctagcagcacgtaaatattggcg

SEQ ID NO: 41098 - DNA, 21 bp, Homo sapiens
tagcagcacgtaaatattggc

SEQ ID NO: 41099 - DNA, 23 bp, Homo sapiens
tagcagcacgtaaatattggcgt

SEQ ID NO: 41100 - DNA, 24 bp, Homo sapiens
tagcagcacgtaaatattggcgta

SEQ ID NO: 41101 - DNA, 25 bp, Homo sapiens
tagcagcacgtaaatattggcgtag

SEQ ID NO: 41102 - DNA, 26 bp, Homo sapiens
tagcagcacgtaaatattggcgtagt

SEQ ID NO: 41103 - DNA, 21 bp, Homo sapiens
agcagcacgtaaatattggcg

SEQ ID NO: 41104 - DNA, 23 bp, Homo sapiens
agcagcacgtaaatattggcgta

SEQ ID NO: 41105 - DNA, 21 bp, Homo sapiens
cagcacgtaaatattggcgta

SEQ ID NO: 41106 - DNA, 22 bp, Homo sapiens
cagcacgtaaatattggcgtag

SEQ ID NO: 41107 - DNA, 23 bp, Homo sapiens
cagcacgtaaatattggcgtagt

SEQ ID NO: 41108 - DNA, 24 bp, Homo sapiens
cagcacgtaaatattggcgtagtg

SEQ ID NO: 41109 - DNA, 28 bp, Homo sapiens
caccaatattactgtgctgctttagtgt

SEQ ID NO: 41110 - DNA, 18 bp, Homo sapiens
accaatattactgtgctg

SEQ ID NO: 41111 - DNA, 19 bp, Homo sapiens
accaatattactgtgctgc

SEQ ID NO: 41112 - DNA, 20 bp, Homo sapiens
accaatattactgtgctgct

SEQ ID NO: 41113 - DNA, 21 bp, Homo sapiens
accaatattactgtgctgctt

SEQ ID NO: 41114 - DNA, 22 bp, Homo sapiens
accaatattactgtgctgcttt

SEQ ID NO: 41115 - DNA, 23 bp, Homo sapiens
accaatattactgtgctgcttta

SEQ ID NO: 41116 - DNA, 24 bp, Homo sapiens
accaatattactgtgctgctttag

SEQ ID NO: 41117 - DNA, 25 bp, Homo sapiens
accaatattactgtgctgctttagt

SEQ ID NO: 41118 - DNA, 27 bp, Homo sapiens
accaatattactgtgctgctttagtgt

SEQ ID NO: 41119 - DNA, 21 bp, Homo sapiens
ccaatattactgtgctgcttt

SEQ ID NO: 41120 - DNA, 25 bp, Homo sapiens
atggtaccctggcatactgagtatt

SEQ ID NO: 41121 - DNA, 21 bp, Homo sapiens
atggtaccctggcatactgag

SEQ ID NO: 41122 - DNA, 19 bp, Homo sapiens
gaaatcaagcgtgggtgag

SEQ ID NO: 41123 - DNA, 20 bp, Homo sapiens
gaaatcaagcgtgggtgaga

SEQ ID NO: 41124 - DNA, 21 bp, Homo sapiens
gaaatcaagcgtgggtgagac

SEQ ID NO: 41125 - DNA, 23 bp, Homo sapiens
gaaatcaagcgtgggtgagacct

SEQ ID NO: 41126 - DNA, 24 bp, Homo sapiens
gaaatcaagcgtgggtgagacctg

SEQ ID NO: 41127 - DNA, 23 bp, Homo sapiens
ggcgacccatacttggtttcaga

SEQ ID NO: 41128 - DNA, 16 bp, Homo sapiens
gcgacccatacttggt

SEQ ID NO: 41129 - DNA, 17 bp, Homo sapiens
gcgacccatacttggtt

SEQ ID NO: 41130 - DNA, 20 bp, Homo sapiens
gcgacccatacttggtttca

SEQ ID NO: 41131 - DNA, 22 bp, Homo sapiens
gcgacccatacttggtttcaga

SEQ ID NO: 41132 - DNA, 23 bp, Homo sapiens
gcgacccatacttggtttcagag

SEQ ID NO: 41133 - DNA, 21 bp, Homo sapiens
cgacccatacttggtttcaga

SEQ ID NO: 41134 - DNA, 18 bp, Homo sapiens
agaaggcagcagtgctcc

SEQ ID NO: 41135 - DNA, 19 bp, Homo sapiens
agaaggcagcagtgctccc

SEQ ID NO: 41136 - DNA, 21 bp, Homo sapiens
agaaggcagcagtgctcccct

SEQ ID NO: 41137 - DNA, 23 bp, Homo sapiens
agaaggcagcagtgctcccctgt

SEQ ID NO: 41138 - DNA, 27 bp, Homo sapiens
agaaggcagcagtgctcccctgtgacg

SEQ ID NO: 41139 - DNA, 19 bp, Homo sapiens
aaggcagcagtgctcccct

SEQ ID NO: 41140 - DNA, 23 bp, Homo sapiens
aggcagcagtgctcccctgtgac

SEQ ID NO: 41141 - DNA, 24 bp, Homo sapiens
aggcagcagtgctcccctgtgacg

SEQ ID NO: 41142 - DNA, 22 bp, Homo sapiens
gcagcagtgctcccctgtgacg

SEQ ID NO: 41143 - DNA, 17 bp, Homo sapiens
tgctcccctgtgacgtg

SEQ ID NO: 41144 - DNA, 23 bp, Homo sapiens
ctcaggaagcaagagaaccctgt

SEQ ID NO: 41145 - DNA, 21 bp, Homo sapiens
tcaggaagcaagagaaccctg

SEQ ID NO: 41146 - DNA, 24 bp, Homo sapiens
tcaggaagcaagagaaccctgtgg

SEQ ID NO: 41147 - DNA, 26 bp, Homo sapiens
tttcccatctgctctcttgttcccag

SEQ ID NO: 41148 - DNA, 24 bp, Homo sapiens
ccatctgctctcttgttcccaggc

SEQ ID NO: 41149 - DNA, 22 bp, Homo sapiens
catctgctctcttgttcccagg

SEQ ID NO: 41150 - DNA, 18 bp, Homo sapiens
atctgctctcttgttccc

SEQ ID NO: 41151 - DNA, 21 bp, Homo sapiens
atctgctctcttgttcccagg

SEQ ID NO: 41152 - DNA, 22 bp, Homo sapiens
atctgctctcttgttcccaggc

SEQ ID NO: 41153 - DNA, 18 bp, Homo sapiens
tgctctcttgttcccagg

SEQ ID NO: 41154 - DNA, 22 bp, Homo sapiens
gttaatgaatcctggaaagtta

SEQ ID NO: 41155 - DNA, 19 bp, Homo sapiens
ttaatgaatcctggaaagt

SEQ ID NO: 41156 - DNA, 23 bp, Homo sapiens
tgtatacacctgatatgtgtatg

SEQ ID NO: 41157 - DNA, 26 bp, Homo sapiens
tgtatacacctgatatgtgtatgtgt

SEQ ID NO: 41158 - DNA, 17 bp, Homo sapiens
gtatacacctgatatgt

SEQ ID NO: 41159 - DNA, 23 bp, Homo sapiens
gtatacacctgatatgtgtatgt

SEQ ID NO: 41160 - DNA, 17 bp, Homo sapiens
cacacatagcaggtgta

SEQ ID NO: 41161 - DNA, 18 bp, Homo sapiens
cacacatagcaggtgtat

SEQ ID NO: 41162 - DNA, 19 bp, Homo sapiens
cacacatagcaggtgtata

SEQ ID NO: 41163 - DNA, 20 bp, Homo sapiens
cacacatagcaggtgtatat

SEQ ID NO: 41164 - DNA, 22 bp, Homo sapiens
cacacatagcaggtgtatatat

SEQ ID NO: 41165 - DNA, 23 bp, Homo sapiens
cacacatagcaggtgtatatata

SEQ ID NO: 41166 - DNA, 24 bp, Homo sapiens
cacacatagcaggtgtatatatag

SEQ ID NO: 41167 - DNA, 23 bp, Homo sapiens
ttggtttcccagccaacgcacca

SEQ ID NO: 41168 - DNA, 22 bp, Homo sapiens
tggtttcccagccaacgcacca

SEQ ID NO: 41169 - DNA, 23 bp, Homo sapiens
tggtttcccagccaacgcaccaa

SEQ ID NO: 41170 - DNA, 21 bp, Homo sapiens
ggtttcccagccaacgcacca

SEQ ID NO: 41171 - DNA, 19 bp, Homo sapiens
gtttcccagccaacgcacc

SEQ ID NO: 41172 - DNA, 20 bp, Homo sapiens
gtttcccagccaacgcacca

SEQ ID NO: 41173 - DNA, 21 bp, Homo sapiens
gtttcccagccaacgcaccaa

SEQ ID NO: 41174 - DNA, 21 bp, Homo sapiens
tttcccagccaacgcaccaaa

SEQ ID NO: 41175 - DNA, 20 bp, Homo sapiens
ttcccagccaacgcaccaaa

SEQ ID NO: 41176 - DNA, 21 bp, Homo sapiens
ttcccagccaacgcaccaaaa

SEQ ID NO: 41177 - DNA, 22 bp, Homo sapiens
ttcccagccaacgcaccaaaaa

SEQ ID NO: 41178 - DNA, 17 bp, Homo sapiens
tcccagccaacgcacca

SEQ ID NO: 41179 - DNA, 20 bp, Homo sapiens
tcccagccaacgcaccaaaa

SEQ ID NO: 41180 - DNA, 21 bp, Homo sapiens
tcccagccaacgcaccaaaaa

SEQ ID NO: 41181 - DNA, 16 bp, Homo sapiens
cccagccaacgcacca

SEQ ID NO: 41182 - DNA, 17 bp, Homo sapiens
cccagccaacgcaccaa

SEQ ID NO: 41183 - DNA, 18 bp, Homo sapiens
cccagccaacgcaccaaa

SEQ ID NO: 41184 - DNA, 22 bp, Homo sapiens
ggctccttggtctaggggtaat

SEQ ID NO: 41185 - DNA, 23 bp, Homo sapiens
ggctccttggtctaggggtaatg

SEQ ID NO: 41186 - DNA, 21 bp, Homo sapiens
ctccttggtctaggggtaatg

SEQ ID NO: 41187 - DNA, 18 bp, Homo sapiens
cttggtctaggggtaatg

SEQ ID NO: 41188 - DNA, 17 bp, Homo sapiens
gtgaggactcgggaggt

SEQ ID NO: 41189 - DNA, 18 bp, Homo sapiens
gtgaggactcgggaggtg

SEQ ID NO: 41190 - DNA, 20 bp, Homo sapiens
gtgaggactcgggaggtgga

SEQ ID NO: 41191 - DNA, 21 bp, Homo sapiens
gtgaggactcgggaggtggag

SEQ ID NO: 41192 - DNA, 22 bp, Homo sapiens
gtgaggactcgggaggtggagg

SEQ ID NO: 41193 - DNA, 23 bp, Homo sapiens
gtgaggactcgggaggtggaggg

SEQ ID NO: 41194 - DNA, 24 bp, Homo sapiens
gtgaggactcgggaggtggagggt

SEQ ID NO: 41195 - DNA, 25 bp, Homo sapiens
gtgaggactcgggaggtggagggtg

SEQ ID NO: 41196 - DNA, 18 bp, Homo sapiens
tgaggactcgggaggtgg

SEQ ID NO: 41197 - DNA, 17 bp, Homo sapiens
gaggactcgggaggtgg

SEQ ID NO: 41198 - DNA, 21 bp, Homo sapiens
ttctccccccacctcctctct

SEQ ID NO: 41199 - DNA, 20 bp, Homo sapiens
ccccacctcctctctcctca

SEQ ID NO: 41200 - DNA, 22 bp, Homo sapiens
ccccacctcctctctcctcagg

SEQ ID NO: 41201 - DNA, 23 bp, Homo sapiens
ccccacctcctctctcctcaggt

SEQ ID NO: 41202 - DNA, 24 bp, Homo sapiens
ccccacctcctctctcctcaggtg

SEQ ID NO: 41203 - DNA, 21 bp, Homo sapiens
cccacctcctctctcctcagg

SEQ ID NO: 41204 - DNA, 23 bp, Homo sapiens
agtcccactaatgccagctcagt

SEQ ID NO: 41205 - DNA, 24 bp, Homo sapiens
aagtcccactaatgccagctcagt

SEQ ID NO: 41206 - DNA, 23 bp, Homo sapiens
aagtcccactaatgccagctcag

SEQ ID NO: 41207 - DNA, 22 bp, Homo sapiens
aagtcccactaatgccagctca

SEQ ID NO: 41208 - DNA, 21 bp, Homo sapiens
aagtcccactaatgccagctc

SEQ ID NO: 41209 - DNA, 24 bp, Homo sapiens
taaaagtcccactaatgccagctc

SEQ ID NO: 41210 - DNA, 20 bp, Homo sapiens
aagtcccactaatgccagct

SEQ ID NO: 41211 - DNA, 23 bp, Homo sapiens
taaaagtcccactaatgccagct

SEQ ID NO: 41212 - DNA, 22 bp, Homo sapiens
taaaagtcccactaatgccagc

SEQ ID NO: 41213 - DNA, 20 bp, Homo sapiens
taaaagtcccactaatgcca

SEQ ID NO: 41214 - DNA, 19 bp, Homo sapiens
taaaagtcccactaatgcc

SEQ ID NO: 41215 - DNA, 23 bp, Homo sapiens
tggcattagtgggactttttttt

SEQ ID NO: 41216 - DNA, 24 bp, Homo sapiens
actggcattagtgggacttttttt

SEQ ID NO: 41217 - DNA, 21 bp, Homo sapiens
tggcattagtgggactttttt

SEQ ID NO: 41218 - DNA, 23 bp, Homo sapiens
actggcattagtgggactttttt

SEQ ID NO: 41219 - DNA, 20 bp, Homo sapiens
tggcattagtgggacttttt

SEQ ID NO: 41220 - DNA, 22 bp, Homo sapiens
actggcattagtgggacttttt

SEQ ID NO: 41221 - DNA, 20 bp, Homo sapiens
actggcattagtgggacttt

SEQ ID NO: 41222 - DNA, 18 bp, Homo sapiens
actggcattagtgggact

SEQ ID NO: 41223 - DNA, 20 bp, Homo sapiens
taccttcttgtataagcact

SEQ ID NO: 41224 - DNA, 16 bp, Homo sapiens
accttcttgtataagc

SEQ ID NO: 41225 - DNA, 17 bp, Homo sapiens
accttcttgtataagca

SEQ ID NO: 41226 - DNA, 18 bp, Homo sapiens
accttcttgtataagcac

SEQ ID NO: 41227 - DNA, 19 bp, Homo sapiens
accttcttgtataagcact

SEQ ID NO: 41228 - DNA, 20 bp, Homo sapiens
accttcttgtataagcactg

SEQ ID NO: 41229 - DNA, 21 bp, Homo sapiens
accttcttgtataagcactgt

SEQ ID NO: 41230 - DNA, 22 bp, Homo sapiens
accttcttgtataagcactgtg

SEQ ID NO: 41231 - DNA, 23 bp, Homo sapiens
accttcttgtataagcactgtgc

SEQ ID NO: 41232 - DNA, 24 bp, Homo sapiens
accttcttgtataagcactgtgct

SEQ ID NO: 41233 - DNA, 25 bp, Homo sapiens
accttcttgtataagcactgtgcta

SEQ ID NO: 41234 - DNA, 26 bp, Homo sapiens
accttcttgtataagcactgtgctaa

SEQ ID NO: 41235 - DNA, 28 bp, Homo sapiens
accttcttgtataagcactgtgctaaaa

SEQ ID NO: 41236 - DNA, 16 bp, Homo sapiens
ctgtgctaaaattgca

SEQ ID NO: 41237 - DNA, 21 bp, Homo sapiens
aaggagctcacagtctattga

SEQ ID NO: 41238 - DNA, 23 bp, Homo sapiens
aaggagctcacagtctattgagt

SEQ ID NO: 41239 - DNA, 24 bp, Homo sapiens
aaggagctcacagtctattgagtt

SEQ ID NO: 41240 - DNA, 20 bp, Homo sapiens
cactagattgtgagctcctg

SEQ ID NO: 41241 - DNA, 21 bp, Homo sapiens
cactagattgtgagctcctgg

SEQ ID NO: 41242 - DNA, 23 bp, Homo sapiens
cactagattgtgagctcctggag

SEQ ID NO: 41243 - DNA, 24 bp, Homo sapiens
cactagattgtgagctcctggagg

SEQ ID NO: 41244 - DNA, 22 bp, Homo sapiens
actagattgtgagctcctggag

SEQ ID NO: 41245 - DNA, 18 bp, Homo sapiens
gaaattattgtacatcgg

SEQ ID NO: 41246 - DNA, 20 bp, Homo sapiens
gaaattattgtacatcggat

SEQ ID NO: 41247 - DNA, 21 bp, Homo sapiens
gaaattattgtacatcggatg

SEQ ID NO: 41248 - DNA, 22 bp, Homo sapiens
gaaattattgtacatcggatga

SEQ ID NO: 41249 - DNA, 23 bp, Homo sapiens
gaaattattgtacatcggatgag

SEQ ID NO: 41250 - DNA, 24 bp, Homo sapiens
gaaattattgtacatcggatgagc

SEQ ID NO: 41251 - DNA, 18 bp, Homo sapiens
aaattattgtacatcgga

SEQ ID NO: 41252 - DNA, 19 bp, Homo sapiens
aaattattgtacatcggat

SEQ ID NO: 41253 - DNA, 20 bp, Homo sapiens
aaattattgtacatcggatg

SEQ ID NO: 41254 - DNA, 21 bp, Homo sapiens
aaattattgtacatcggatga

SEQ ID NO: 41255 - DNA, 23 bp, Homo sapiens
aaattattgtacatcggatgagc

SEQ ID NO: 41256 - DNA, 24 bp, Homo sapiens
aaattattgtacatcggatgagct

SEQ ID NO: 41257 - DNA, 20 bp, Homo sapiens
aattattgtacatcggatga

SEQ ID NO: 41258 - DNA, 21 bp, Homo sapiens
aattattgtacatcggatgag

SEQ ID NO: 41259 - DNA, 22 bp, Homo sapiens
aattattgtacatcggatgagc

SEQ ID NO: 41260 - DNA, 23 bp, Homo sapiens
aattattgtacatcggatgagct

SEQ ID NO: 41261 - DNA, 16 bp, Homo sapiens
ttgtacatcggatgag

SEQ ID NO: 41262 - DNA, 24 bp, Homo sapiens
tggatatgatgactgaaataagct

SEQ ID NO: 41263 - DNA, 23 bp, Homo sapiens
tggatatgatgactgaaataagc

SEQ ID NO: 41264 - DNA, 22 bp, Homo sapiens
tggatatgatgactgaaataag

SEQ ID NO: 41265 - DNA, 21 bp, Homo sapiens
tggatatgatgactgaaataa

SEQ ID NO: 41266 - DNA, 22 bp, Homo sapiens
ctggatatgatgactgaaataa

SEQ ID NO: 41267 - DNA, 19 bp, Homo sapiens
ggatatgatgactgaaata

SEQ ID NO: 41268 - DNA, 21 bp, Homo sapiens
ctggatatgatgactgaaata

SEQ ID NO: 41269 - DNA, 19 bp, Homo sapiens
tggatatgatgactgaaat

SEQ ID NO: 41270 - DNA, 20 bp, Homo sapiens
ctggatatgatgactgaaat

SEQ ID NO: 41271 - DNA, 19 bp, Homo sapiens
ctggatatgatgactgaaa

SEQ ID NO: 41272 - DNA, 18 bp, Homo sapiens
ctggatatgatgactgaa

SEQ ID NO: 41273 - DNA, 27 bp, Homo sapiens
ctgtagcctgggagcaatggggtgtat

SEQ ID NO: 41274 - DNA, 26 bp, Homo sapiens
tctgtagcctgggagcaatggggtgt

SEQ ID NO: 41275 - DNA, 24 bp, Homo sapiens
ctgtagcctgggagcaatggggtg

SEQ ID NO: 41276 - DNA, 23 bp, Homo sapiens
ctgtagcctgggagcaatggggt

SEQ ID NO: 41277 - DNA, 22 bp, Homo sapiens
ctgtagcctgggagcaatgggg

SEQ ID NO: 41278 - DNA, 23 bp, Homo sapiens
tctgtagcctgggagcaatgggg

SEQ ID NO: 41279 - DNA, 21 bp, Homo sapiens
ctgtagcctgggagcaatggg

SEQ ID NO: 41280 - DNA, 22 bp, Homo sapiens
tctgtagcctgggagcaatggg

SEQ ID NO: 41281 - DNA, 21 bp, Homo sapiens
tctgtagcctgggagcaatgg

SEQ ID NO: 41282 - DNA, 22 bp, Homo sapiens
tacaggtctgtagcctgggagc

SEQ ID NO: 41283 - DNA, 17 bp, Homo sapiens
cgaaaacagcaattacc

SEQ ID NO: 41284 - DNA, 18 bp, Homo sapiens
cgaaaacagcaattacct

SEQ ID NO: 41285 - DNA, 19 bp, Homo sapiens
cgaaaacagcaattacctt

SEQ ID NO: 41286 - DNA, 20 bp, Homo sapiens
cgaaaacagcaattaccttt

SEQ ID NO: 41287 - DNA, 21 bp, Homo sapiens
cgaaaacagcaattacctttg

SEQ ID NO: 41288 - DNA, 23 bp, Homo sapiens
cgaaaacagcaattacctttgca

SEQ ID NO: 41289 - DNA, 24 bp, Homo sapiens
cgaaaacagcaattacctttgcac

SEQ ID NO: 41290 - DNA, 25 bp, Homo sapiens
cgaaaacagcaattacctttgcacc

SEQ ID NO: 41291 - DNA, 20 bp, Homo sapiens
gaaaacagcaattacctttg

SEQ ID NO: 41292 - DNA, 22 bp, Homo sapiens
gaaaacagcaattacctttgca

SEQ ID NO: 41293 - DNA, 24 bp, Homo sapiens
gaaaacagcaattacctttgcacc

SEQ ID NO: 41294 - DNA, 23 bp, Homo sapiens
tgcctcctccgtggcctcaggtg

SEQ ID NO: 41295 - DNA, 24 bp, Homo sapiens
ctgcctcctccgtggcctcaggtg

SEQ ID NO: 41296 - DNA, 22 bp, Homo sapiens
tgcctcctccgtggcctcaggt

SEQ ID NO: 41297 - DNA, 23 bp, Homo sapiens
ctgcctcctccgtggcctcaggt

SEQ ID NO: 41298 - DNA, 24 bp, Homo sapiens
cctgcctcctccgtggcctcaggt

SEQ ID NO: 41299 - DNA, 21 bp, Homo sapiens
tgcctcctccgtggcctcagg

SEQ ID NO: 41300 - DNA, 22 bp, Homo sapiens
ctgcctcctccgtggcctcagg

SEQ ID NO: 41301 - DNA, 21 bp, Homo sapiens
ctgcctcctccgtggcctcag

SEQ ID NO: 41302 - DNA, 25 bp, Homo sapiens
tgggctgctgagaaggggcagggtc

SEQ ID NO: 41303 - DNA, 24 bp, Homo sapiens
tgggctgctgagaaggggcagggt

SEQ ID NO: 41304 - DNA, 26 bp, Homo sapiens
cgtgggctgctgagaaggggcagggt

SEQ ID NO: 41305 - DNA, 23 bp, Homo sapiens
tgggctgctgagaaggggcaggg

SEQ ID NO: 41306 - DNA, 24 bp, Homo sapiens
gtgggctgctgagaaggggcaggg

SEQ ID NO: 41307 - DNA, 22 bp, Homo sapiens
tgggctgctgagaaggggcagg

SEQ ID NO: 41308 - DNA, 23 bp, Homo sapiens
gtgggctgctgagaaggggcagg

SEQ ID NO: 41309 - DNA, 21 bp, Homo sapiens
tgggctgctgagaaggggcag

SEQ ID NO: 41310 - DNA, 22 bp, Homo sapiens
gtgggctgctgagaaggggcag

SEQ ID NO: 41311 - DNA, 20 bp, Homo sapiens
gtgggctgctgagaaggggc

SEQ ID NO: 41312 - DNA, 24 bp, Homo sapiens
ctcagtaagtggcactctgtcttc

SEQ ID NO: 41313 - DNA, 25 bp, Homo sapiens
tctcagtaagtggcactctgtcttc

SEQ ID NO: 41314 - DNA, 22 bp, Homo sapiens
ctcagtaagtggcactctgtct

SEQ ID NO: 41315 - DNA, 23 bp, Homo sapiens
tctcagtaagtggcactctgtct

SEQ ID NO: 41316 - DNA, 21 bp, Homo sapiens
ctcagtaagtggcactctgtc

SEQ ID NO: 41317 - DNA, 22 bp, Homo sapiens
tctcagtaagtggcactctgtc

SEQ ID NO: 41318 - DNA, 20 bp, Homo sapiens
ctcagtaagtggcactctgt

SEQ ID NO: 41319 - DNA, 20 bp, Homo sapiens
tctcagtaagtggcactctg

SEQ ID NO: 41320 - DNA, 23 bp, Homo sapiens
gacagagtgccacttactgaaag

SEQ ID NO: 41321 - DNA, 22 bp, Homo sapiens
gacagagtgccacttactgaaa

SEQ ID NO: 41322 - DNA, 22 bp, Homo sapiens
agacagagtgccacttactgaa

SEQ ID NO: 41323 - DNA, 23 bp, Homo sapiens
aagacagagtgccacttactgaa

SEQ ID NO: 41324 - DNA, 16 bp, Homo sapiens
ggactacgtcatgggc

SEQ ID NO: 41325 - DNA, 21 bp, Homo sapiens
gaataggactacgtcatgggc

SEQ ID NO: 41326 - DNA, 22 bp, Homo sapiens
agaataggactacgtcatgggc

SEQ ID NO: 41327 - DNA, 23 bp, Homo sapiens
gagaataggactacgtcatgggc

SEQ ID NO: 41328 - DNA, 22 bp, Homo sapiens
agcagagaataggactacgtca

SEQ ID NO: 41329 - DNA, 22 bp, Homo sapiens
cagcagagaataggactacgtc

SEQ ID NO: 41330 - DNA, 23 bp, Homo sapiens
aagcagcagagaataggactacg

SEQ ID NO: 41331 - DNA, 24 bp, Homo sapiens
agaagcagcagagaataggactac

SEQ ID NO: 41332 - DNA, 23 bp, Homo sapiens
agaagcagcagagaataggacta

SEQ ID NO: 41333 - DNA, 18 bp, Homo sapiens
gcagcagagaataggact

SEQ ID NO: 41334 - DNA, 24 bp, Homo sapiens
ggagaagcagcagagaataggact

SEQ ID NO: 41335 - DNA, 22 bp, Homo sapiens
ggagaagcagcagagaatagga

SEQ ID NO: 41336 - DNA, 17 bp, Homo sapiens
ggagaagcagcagagaa

SEQ ID NO: 41337 - DNA, 16 bp, Homo sapiens
ggagaagcagcagaga

SEQ ID NO: 41338 - DNA, 20 bp, Homo sapiens
tgcctaggctgagactgcag

SEQ ID NO: 41339 - DNA, 21 bp, Homo sapiens
tgcctaggctgagactgcagt

SEQ ID NO: 41340 - DNA, 23 bp, Homo sapiens
tgcctaggctgagactgcagtgg

SEQ ID NO: 41341 - DNA, 24 bp, Homo sapiens
tgcctaggctgagactgcagtggt

SEQ ID NO: 41342 - DNA, 25 bp, Homo sapiens
tgcctaggctgagactgcagtggtg

SEQ ID NO: 41343 - DNA, 22 bp, Homo sapiens
ccggtgagcgctcgctggcctg

SEQ ID NO: 41344 - DNA, 23 bp, Homo sapiens
cccggtgagcgctcgctggcctg

SEQ ID NO: 41345 - DNA, 18 bp, Homo sapiens
gtgagcgctcgctggcct

SEQ ID NO: 41346 - DNA, 21 bp, Homo sapiens
ccggtgagcgctcgctggcct

SEQ ID NO: 41347 - DNA, 16 bp, Homo sapiens
tgagcgctcgctggcc

SEQ ID NO: 41348 - DNA, 17 bp, Homo sapiens
gtgagcgctcgctggcc

SEQ ID NO: 41349 - DNA, 19 bp, Homo sapiens
cggtgagcgctcgctggcc

SEQ ID NO: 41350 - DNA, 20 bp, Homo sapiens
ccggtgagcgctcgctggcc

SEQ ID NO: 41351 - DNA, 21 bp, Homo sapiens
cccggtgagcgctcgctggcc

SEQ ID NO: 41352 - DNA, 22 bp, Homo sapiens
gcccggtgagcgctcgctggcc

SEQ ID NO: 41353 - DNA, 16 bp, Homo sapiens
gtgagcgctcgctggc

SEQ ID NO: 41354 - DNA, 19 bp, Homo sapiens
ccggtgagcgctcgctggc

SEQ ID NO: 41355 - DNA, 21 bp, Homo sapiens
gcccggtgagcgctcgctggc

SEQ ID NO: 41356 - DNA, 17 bp, Homo sapiens
caagagggaggtgaccg

SEQ ID NO: 41357 - DNA, 18 bp, Homo sapiens
acaagagggaggtgaccg

SEQ ID NO: 41358 - DNA, 19 bp, Homo sapiens
gacaagagggaggtgaccg

SEQ ID NO: 41359 - DNA, 20 bp, Homo sapiens
ggacaagagggaggtgaccg

SEQ ID NO: 41360 - DNA, 21 bp, Homo sapiens
cggacaagagggaggtgaccg

SEQ ID NO: 41361 - DNA, 22 bp, Homo sapiens
ccggacaagagggaggtgaccg

SEQ ID NO: 41362 - DNA, 23 bp, Homo sapiens
gccggacaagagggaggtgaccg

SEQ ID NO: 41363 - DNA, 25 bp, Homo sapiens
atgccggacaagagggaggtgaccg

SEQ ID NO: 41364 - DNA, 26 bp, Homo sapiens
tatgccggacaagagggaggtgaccg

SEQ ID NO: 41365 - DNA, 20 bp, Homo sapiens
cggacaagagggaggtgacc

SEQ ID NO: 41366 - DNA, 19 bp, Homo sapiens
cggacaagagggaggtgac

SEQ ID NO: 41367 - DNA, 18 bp, Homo sapiens
cggacaagagggaggtga

SEQ ID NO: 41368 - DNA, 20 bp, Homo sapiens
gccggacaagagggaggtga

SEQ ID NO: 41369 - DNA, 19 bp, Homo sapiens
gccggacaagagggaggtg

SEQ ID NO: 41370 - DNA, 19 bp, Homo sapiens
atgccggacaagagggagg

SEQ ID NO: 41371 - DNA, 20 bp, Homo sapiens
tatgccggacaagagggagg

SEQ ID NO: 41372 - DNA, 21 bp, Homo sapiens
ttatgccggacaagagggagg

SEQ ID NO: 41373 - DNA, 23 bp, Homo sapiens
tgttatgccggacaagagggagg

SEQ ID NO: 41374 - DNA, 21 bp, Homo sapiens
tgttatgccggacaagaggga

SEQ ID NO: 41375 - DNA, 21 bp, Homo sapiens
acacgcaacacacatatatac

SEQ ID NO: 41376 - DNA, 24 bp, Homo sapiens
atacacatacacgcaacacacata

SEQ ID NO: 41377 - DNA, 19 bp, Homo sapiens
acatacacgcaacacacat

SEQ ID NO: 41378 - DNA, 22 bp, Homo sapiens
atacacatacacgcaacacaca

SEQ ID NO: 41379 - DNA, 23 bp, Homo sapiens
catacacatacacgcaacacaca

SEQ ID NO: 41380 - DNA, 21 bp, Homo sapiens
atacacatacacgcaacacac

SEQ ID NO: 41381 - DNA, 20 bp, Homo sapiens
atacacatacacgcaacaca

SEQ ID NO: 41382 - DNA, 25 bp, Homo sapiens
aaccgcgattactcttgcacgaacc

SEQ ID NO: 41383 - DNA, 24 bp, Homo sapiens
aaccgcgattactcttgcacgaac

SEQ ID NO: 41384 - DNA, 24 bp, Homo sapiens
aaaccgcgattactcttgcacgaa

SEQ ID NO: 41385 - DNA, 21 bp, Homo sapiens
accgcgattactcttgcacga

SEQ ID NO: 41386 - DNA, 22 bp, Homo sapiens
aaccgcgattactcttgcacga

SEQ ID NO: 41387 - DNA, 23 bp, Homo sapiens
aaaccgcgattactcttgcacga

SEQ ID NO: 41388 - DNA, 21 bp, Homo sapiens
aaccgcgattactcttgcacg

SEQ ID NO: 41389 - DNA, 23 bp, Homo sapiens
caaaaccgcgattactcttgcac

SEQ ID NO: 41390 - DNA, 19 bp, Homo sapiens
aaccgcgattactcttgca

SEQ ID NO: 41391 - DNA, 21 bp, Homo sapiens
caaaaccgcgattactcttgc

SEQ ID NO: 41392 - DNA, 22 bp, Homo sapiens
ccaaaaccgcgattactcttgc

SEQ ID NO: 41393 - DNA, 20 bp, Homo sapiens
caaaaccgcgattactcttg

SEQ ID NO: 41394 - DNA, 18 bp, Homo sapiens
caaaaccgcgattactct

SEQ ID NO: 41395 - DNA, 26 bp, Homo sapiens
ggggggccgatacactgtacgagagt

SEQ ID NO: 41396 - DNA, 21 bp, Homo sapiens
gggggccgatacactgtacga

SEQ ID NO: 41397 - DNA, 22 bp, Homo sapiens
gggggccgatacactgtacgag

SEQ ID NO: 41398 - DNA, 24 bp, Homo sapiens
gggggccgatacactgtacgagag

SEQ ID NO: 41399 - DNA, 22 bp, Homo sapiens
tcacagtgaaccggtctctttc

SEQ ID NO: 41400 - DNA, 23 bp, Homo sapiens
tcacagtgaaccggtctctttcc

SEQ ID NO: 41401 - DNA, 24 bp, Homo sapiens
tcacagtgaaccggtctctttccc

SEQ ID NO: 41402 - DNA, 25 bp, Homo sapiens
tcacagtgaaccggtctctttccct

SEQ ID NO: 41403 - DNA, 26 bp, Homo sapiens
tcacagtgaaccggtctctttcccta

SEQ ID NO: 41404 - DNA, 25 bp, Homo sapiens
cacagtgaaccggtctctttcccta

SEQ ID NO: 41405 - DNA, 20 bp, Homo sapiens
acagtgaaccggtctctttc

SEQ ID NO: 41406 - DNA, 26 bp, Homo sapiens
ctcgttcaagtaatccaggataggct

SEQ ID NO: 41407 - DNA, 24 bp, Homo sapiens
tcgttcaagtaatccaggataggc

SEQ ID NO: 41408 - DNA, 25 bp, Homo sapiens
tcgttcaagtaatccaggataggct

SEQ ID NO: 41409 - DNA, 22 bp, Homo sapiens
cgttcaagtaatccaggatagg

SEQ ID NO: 41410 - DNA, 24 bp, Homo sapiens
cgttcaagtaatccaggataggct

SEQ ID NO: 41411 - DNA, 23 bp, Homo sapiens
gttcaagtaatccaggataggct

SEQ ID NO: 41412 - DNA, 24 bp, Homo sapiens
gttcaagtaatccaggataggctg

SEQ ID NO: 41413 - DNA, 17 bp, Homo sapiens
ttcaagtaatccaggat

SEQ ID NO: 41414 - DNA, 18 bp, Homo sapiens
ttcaagtaatccaggata

SEQ ID NO: 41415 - DNA, 21 bp, Homo sapiens
ttcaagtaatccaggataggc

SEQ ID NO: 41416 - DNA, 23 bp, Homo sapiens
ttcaagtaatccaggataggctg

SEQ ID NO: 41417 - DNA, 25 bp, Homo sapiens
ttcaagtaatccaggataggctgtg

SEQ ID NO: 41418 - DNA, 26 bp, Homo sapiens
ttcaagtaatccaggataggctgtgc

SEQ ID NO: 41419 - DNA, 27 bp, Homo sapiens
ttcaagtaatccaggataggctgtgca

SEQ ID NO: 41420 - DNA, 28 bp, Homo sapiens
ttcaagtaatccaggataggctgtgcag

SEQ ID NO: 41421 - DNA, 21 bp, Homo sapiens
tcaagtaatccaggataggct

SEQ ID NO: 41422 - DNA, 24 bp, Homo sapiens
caagtaatccaggataggctgtgc

SEQ ID NO: 41423 - DNA, 19 bp, Homo sapiens
aatgggcctattcttggtt

SEQ ID NO: 41424 - DNA, 22 bp, Homo sapiens
gggcctattcttggttacttgc

SEQ ID NO: 41425 - DNA, 23 bp, Homo sapiens
gggcctattcttggttacttgca

SEQ ID NO: 41426 - DNA, 20 bp, Homo sapiens
ggcctattcttggttacttg

SEQ ID NO: 41427 - DNA, 18 bp, Homo sapiens
cctattcttggttacttg

SEQ ID NO: 41428 - DNA, 20 bp, Homo sapiens
cctattcttggttacttgca

SEQ ID NO: 41429 - DNA, 21 bp, Homo sapiens
cctattcttggttacttgcac

SEQ ID NO: 41430 - DNA, 23 bp, Homo sapiens
cctattcttggttacttgcacgg

SEQ ID NO: 41431 - DNA, 24 bp, Homo sapiens
cctattcttggttacttgcacggg

SEQ ID NO: 41432 - DNA, 21 bp, Homo sapiens
ctattcttggttacttgcacg

SEQ ID NO: 41433 - DNA, 22 bp, Homo sapiens
ctattcttggttacttgcacgg

SEQ ID NO: 41434 - DNA, 21 bp, Homo sapiens
gcccagggaaccagttggggc

SEQ ID NO: 41435 - DNA, 19 bp, Homo sapiens
cccagggaaccagttgggg

SEQ ID NO: 41436 - DNA, 20 bp, Homo sapiens
cccagggaaccagttggggc

SEQ ID NO: 41437 - DNA, 21 bp, Homo sapiens
cccagggaaccagttggggct

SEQ ID NO: 41438 - DNA, 22 bp, Homo sapiens
cccagggaaccagttggggctt

SEQ ID NO: 41439 - DNA, 23 bp, Homo sapiens
cccagggaaccagttggggcttc

SEQ ID NO: 41440 - DNA, 24 bp, Homo sapiens
cccagggaaccagttggggcttcc

SEQ ID NO: 41441 - DNA, 25 bp, Homo sapiens
cccagggaaccagttggggcttccg

SEQ ID NO: 41442 - DNA, 26 bp, Homo sapiens
cccagggaaccagttggggcttccgc

SEQ ID NO: 41443 - DNA, 20 bp, Homo sapiens
ccagggaaccagttggggct

SEQ ID NO: 41444 - DNA, 21 bp, Homo sapiens
ccagggaaccagttggggctt

SEQ ID NO: 41445 - DNA, 25 bp, Homo sapiens
ccagggaaccagttggggcttccgc

SEQ ID NO: 41446 - DNA, 16 bp, Homo sapiens
cagggaaccagttggg

SEQ ID NO: 41447 - DNA, 22 bp, Homo sapiens
cagggaaccagttggggcttcc

SEQ ID NO: 41448 - DNA, 17 bp, Homo sapiens
tgcagaggctctaactg

SEQ ID NO: 41449 - DNA, 22 bp, Homo sapiens
aggctctaactggctttccctg

SEQ ID NO: 41450 - DNA, 23 bp, Homo sapiens
aggctctaactggctttccctgc

SEQ ID NO: 41451 - DNA, 25 bp, Homo sapiens
aggctctaactggctttccctgcag

SEQ ID NO: 41452 - DNA, 28 bp, Homo sapiens
aggctctaactggctttccctgcagtcc

SEQ ID NO: 41453 - DNA, 21 bp, Homo sapiens
ctctaactggctttccctgca

SEQ ID NO: 41454 - DNA, 23 bp, Homo sapiens
ctctaactggctttccctgcagt

SEQ ID NO: 41455 - DNA, 24 bp, Homo sapiens
agctggtgttgtgaatcaggccgt

SEQ ID NO: 41456 - DNA, 25 bp, Homo sapiens
agctggtgttgtgaatcaggccgtt

SEQ ID NO: 41457 - DNA, 26 bp, Homo sapiens
agctggtgttgtgaatcaggccgttg

SEQ ID NO: 41458 - DNA, 27 bp, Homo sapiens
agctggtgttgtgaatcaggccgttgc

SEQ ID NO: 41459 - DNA, 28 bp, Homo sapiens
agctggtgttgtgaatcaggccgttgcc

SEQ ID NO: 41460 - DNA, 23 bp, Homo sapiens
gctggtgttgtgaatcaggccgt

SEQ ID NO: 41461 - DNA, 19 bp, Homo sapiens
cggctacttcacaacacca

SEQ ID NO: 41462 - DNA, 21 bp, Homo sapiens
cggctacttcacaacaccagg

SEQ ID NO: 41463 - DNA, 22 bp, Homo sapiens
cggctacttcacaacaccaggg

SEQ ID NO: 41464 - DNA, 23 bp, Homo sapiens
cggctacttcacaacaccagggc

SEQ ID NO: 41465 - DNA, 17 bp, Homo sapiens
gctacttcacaacacca

SEQ ID NO: 41466 - DNA, 19 bp, Homo sapiens
gctacttcacaacaccagg

SEQ ID NO: 41467 - DNA, 20 bp, Homo sapiens
gctacttcacaacaccaggg

SEQ ID NO: 41468 - DNA, 21 bp, Homo sapiens
gctacttcacaacaccagggc

SEQ ID NO: 41469 - DNA, 23 bp, Homo sapiens
gctacttcacaacaccagggcca

SEQ ID NO: 41470 - DNA, 24 bp, Homo sapiens
gctacttcacaacaccagggccac

SEQ ID NO: 41471 - DNA, 21 bp, Homo sapiens
ctacttcacaacaccagggcc

SEQ ID NO: 41472 - DNA, 23 bp, Homo sapiens
ttcacaacaccagggccacacca

SEQ ID NO: 41473 - DNA, 17 bp, Homo sapiens
ggtgccaggcacggtgt

SEQ ID NO: 41474 - DNA, 18 bp, Homo sapiens
ggtgccaggcacggtgtc

SEQ ID NO: 41475 - DNA, 21 bp, Homo sapiens
ggtgccaggcacggtgtcagc

SEQ ID NO: 41476 - DNA, 22 bp, Homo sapiens
ggtgccaggcacggtgtcagca

SEQ ID NO: 41477 - DNA, 24 bp, Homo sapiens
ggtgccaggcacggtgtcagcagg

SEQ ID NO: 41478 - DNA, 23 bp, Homo sapiens
gtgccaggcacggtgtcagcagg

SEQ ID NO: 41479 - DNA, 21 bp, Homo sapiens
gccaggcacggtgtcagcagg

SEQ ID NO: 41480 - DNA, 26 bp, Homo sapiens
caggcacggtgtcagcaggcaacatg

SEQ ID NO: 41481 - DNA, 23 bp, Homo sapiens
gcacggtgtcagcaggcaacatg

SEQ ID NO: 41482 - DNA, 18 bp, Homo sapiens
cacggtgtcagcaggcaa

SEQ ID NO: 41483 - DNA, 20 bp, Homo sapiens
cacggtgtcagcaggcaaca

SEQ ID NO: 41484 - DNA, 20 bp, Homo sapiens
cggtgtcagcaggcaacatg

SEQ ID NO: 41485 - DNA, 19 bp, Homo sapiens
ggtgtcagcaggcaacatg

SEQ ID NO: 41486 - DNA, 18 bp, Homo sapiens
gtgtcagcaggcaacatg

SEQ ID NO: 41487 - DNA, 16 bp, Homo sapiens
gtcagcaggcaacatg

SEQ ID NO: 41488 - DNA, 22 bp, Homo sapiens
gtgagggcatgcaggcctggat

SEQ ID NO: 41489 - DNA, 23 bp, Homo sapiens
gtgagggcatgcaggcctggatg

SEQ ID NO: 41490 - DNA, 24 bp, Homo sapiens
gtgagggcatgcaggcctggatgg

SEQ ID NO: 41491 - DNA, 25 bp, Homo sapiens
gtgagggcatgcaggcctggatggg

SEQ ID NO: 41492 - DNA, 21 bp, Homo sapiens
tgagggcatgcaggcctggat

SEQ ID NO: 41493 - DNA, 22 bp, Homo sapiens
tgagggcatgcaggcctggatg

SEQ ID NO: 41494 - DNA, 23 bp, Homo sapiens
tgagggcatgcaggcctggatgg

SEQ ID NO: 41495 - DNA, 24 bp, Homo sapiens
tgagggcatgcaggcctggatggg

SEQ ID NO: 41496 - DNA, 25 bp, Homo sapiens
tgagggcatgcaggcctggatgggg

SEQ ID NO: 41497 - DNA, 26 bp, Homo sapiens
tgagggcatgcaggcctggatggggc

SEQ ID NO: 41498 - DNA, 24 bp, Homo sapiens
gagggcatgcaggcctggatgggg

SEQ ID NO: 41499 - DNA, 26 bp, Homo sapiens
gagggcatgcaggcctggatggggca

SEQ ID NO: 41500 - DNA, 23 bp, Homo sapiens
agggcatgcaggcctggatgggg

SEQ ID NO: 41501 - DNA, 23 bp, Homo sapiens
gggcatgcaggcctggatggggc

SEQ ID NO: 41502 - DNA, 20 bp, Homo sapiens
gcatgcaggcctggatgggg

SEQ ID NO: 41503 - DNA, 19 bp, Homo sapiens
catgcaggcctggatgggg

SEQ ID NO: 41504 - DNA, 21 bp, Homo sapiens
gtggcctcaccagccctgtgt

SEQ ID NO: 41505 - DNA, 16 bp, Homo sapiens
tcaccagccctgtgtt

SEQ ID NO: 41506 - DNA, 17 bp, Homo sapiens
tcaccagccctgtgttc

SEQ ID NO: 41507 - DNA, 19 bp, Homo sapiens
tcaccagccctgtgttccc

SEQ ID NO: 41508 - DNA, 20 bp, Homo sapiens
tcaccagccctgtgttccct

SEQ ID NO: 41509 - DNA, 21 bp, Homo sapiens
tcaccagccctgtgttcccta

SEQ ID NO: 41510 - DNA, 23 bp, Homo sapiens
tcaccagccctgtgttccctagg

SEQ ID NO: 41511 - DNA, 24 bp, Homo sapiens
tcaccagccctgtgttccctaggg

SEQ ID NO: 41512 - DNA, 21 bp, Homo sapiens
caccagccctgtgttccctag

SEQ ID NO: 41513 - DNA, 18 bp, Homo sapiens
ggttggaggcgtgggttt

SEQ ID NO: 41514 - DNA, 19 bp, Homo sapiens
ggttggaggcgtgggtttt

SEQ ID NO: 41515 - DNA, 18 bp, Homo sapiens
gttggaggcgtgggtttt

SEQ ID NO: 41516 - DNA, 19 bp, Homo sapiens
gttggaggcgtgggtttta

SEQ ID NO: 41517 - DNA, 16 bp, Homo sapiens
ttggaggcgtgggttt

SEQ ID NO: 41518 - DNA, 18 bp, Homo sapiens
ttggaggcgtgggtttta

SEQ ID NO: 41519 - DNA, 21 bp, Homo sapiens
ttggaggcgtgggttttagaa

SEQ ID NO: 41520 - DNA, 16 bp, Homo sapiens
tggaggcgtgggtttt

SEQ ID NO: 41521 - DNA, 17 bp, Homo sapiens
tggaggcgtgggtttta

SEQ ID NO: 41522 - DNA, 18 bp, Homo sapiens
tggaggcgtgggttttag

SEQ ID NO: 41523 - DNA, 22 bp, Homo sapiens
tggaggcgtgggttttagaacc

SEQ ID NO: 41524 - DNA, 16 bp, Homo sapiens
ggaggcgtgggtttta

SEQ ID NO: 41525 - DNA, 22 bp, Homo sapiens
agaattcatggaggctagaagc

SEQ ID NO: 41526 - DNA, 26 bp, Homo sapiens
catcagaattcatggaggctagaagc

SEQ ID NO: 41527 - DNA, 24 bp, Homo sapiens
catcagaattcatggaggctagaa

SEQ ID NO: 41528 - DNA, 22 bp, Homo sapiens
atcagaattcatggaggctaga

SEQ ID NO: 41529 - DNA, 23 bp, Homo sapiens
catcagaattcatggaggctaga

SEQ ID NO: 41530 - DNA, 21 bp, Homo sapiens
atcagaattcatggaggctag

SEQ ID NO: 41531 - DNA, 21 bp, Homo sapiens
catcagaattcatggaggcta

SEQ ID NO: 41532 - DNA, 20 bp, Homo sapiens
catcagaattcatggaggct

SEQ ID NO: 41533 - DNA, 24 bp, Homo sapiens
agcttccatgactcctgatggagg

SEQ ID NO: 41534 - DNA, 23 bp, Homo sapiens
agcttccatgactcctgatggag

SEQ ID NO: 41535 - DNA, 23 bp, Homo sapiens
cagcttccatgactcctgatgga

SEQ ID NO: 41536 - DNA, 20 bp, Homo sapiens
gcttccatgactcctgatgg

SEQ ID NO: 41537 - DNA, 21 bp, Homo sapiens
agcttccatgactcctgatgg

SEQ ID NO: 41538 - DNA, 22 bp, Homo sapiens
cagcttccatgactcctgatgg

SEQ ID NO: 41539 - DNA, 20 bp, Homo sapiens
agcttccatgactcctgatg

SEQ ID NO: 41540 - DNA, 21 bp, Homo sapiens
cagcttccatgactcctgatg

SEQ ID NO: 41541 - DNA, 19 bp, Homo sapiens
agcttccatgactcctgat

SEQ ID NO: 41542 - DNA, 18 bp, Homo sapiens
agcttccatgactcctga

SEQ ID NO: 41543 - DNA, 17 bp, Homo sapiens
agcttccatgactcctg

SEQ ID NO: 41544 - DNA, 24 bp, Homo sapiens
tgagcctctccttccctccagagt

SEQ ID NO: 41545 - DNA, 23 bp, Homo sapiens
tgagcctctccttccctccagag

SEQ ID NO: 41546 - DNA, 22 bp, Homo sapiens
tgagcctctccttccctccaga

SEQ ID NO: 41547 - DNA, 23 bp, Homo sapiens
ctgagcctctccttccctccaga

SEQ ID NO: 41548 - DNA, 20 bp, Homo sapiens
tgagcctctccttccctcca

SEQ ID NO: 41549 - DNA, 24 bp, Homo sapiens
tcagggttggtaggggttgctgtt

SEQ ID NO: 41550 - DNA, 23 bp, Homo sapiens
tcagggttggtaggggttgctgt

SEQ ID NO: 41551 - DNA, 22 bp, Homo sapiens
tcagggttggtaggggttgctg

SEQ ID NO: 41552 - DNA, 20 bp, Homo sapiens
tcagggttggtaggggttgc

SEQ ID NO: 41553 - DNA, 19 bp, Homo sapiens
tcagggttggtaggggttg

SEQ ID NO: 41554 - DNA, 21 bp, Homo sapiens
ggtcagggttggtaggggttg

SEQ ID NO: 41555 - DNA, 17 bp, Homo sapiens
tcagggttggtaggggt

SEQ ID NO: 41556 - DNA, 19 bp, Homo sapiens
acccagggagagacgtaag

SEQ ID NO: 41557 - DNA, 18 bp, Homo sapiens
acccagggagagacgtaa

SEQ ID NO: 41558 - DNA, 26 bp, Homo sapiens
ctctctggtcttgccaccccagaccg

SEQ ID NO: 41559 - DNA, 21 bp, Homo sapiens
ctggtcttgccaccccagacc

SEQ ID NO: 41560 - DNA, 24 bp, Homo sapiens
tctctggtcttgccaccccagacc

SEQ ID NO: 41561 - DNA, 25 bp, Homo sapiens
ctctctggtcttgccaccccagacc

SEQ ID NO: 41562 - DNA, 23 bp, Homo sapiens
tctctggtcttgccaccccagac

SEQ ID NO: 41563 - DNA, 24 bp, Homo sapiens
ctctctggtcttgccaccccagac

SEQ ID NO: 41564 - DNA, 20 bp, Homo sapiens
tctggtcttgccaccccaga

SEQ ID NO: 41565 - DNA, 22 bp, Homo sapiens
tctctggtcttgccaccccaga

SEQ ID NO: 41566 - DNA, 23 bp, Homo sapiens
ctctctggtcttgccaccccaga

SEQ ID NO: 41567 - DNA, 22 bp, Homo sapiens
ctctctggtcttgccaccccag

SEQ ID NO: 41568 - DNA, 18 bp, Homo sapiens
tctctggtcttgccaccc

SEQ ID NO: 41569 - DNA, 25 bp, Homo sapiens
aggggaggttgggccagggatgcct

SEQ ID NO: 41570 - DNA, 23 bp, Homo sapiens
aggggaggttgggccagggatgc

SEQ ID NO: 41571 - DNA, 24 bp, Homo sapiens
taggggaggttgggccagggatgc

SEQ ID NO: 41572 - DNA, 22 bp, Homo sapiens
aggggaggttgggccagggatg

SEQ ID NO: 41573 - DNA, 23 bp, Homo sapiens
taggggaggttgggccagggatg

SEQ ID NO: 41574 - DNA, 21 bp, Homo sapiens
aggggaggttgggccagggat

SEQ ID NO: 41575 - DNA, 22 bp, Homo sapiens
taggggaggttgggccagggat

SEQ ID NO: 41576 - DNA, 21 bp, Homo sapiens
taggggaggttgggccaggga

SEQ ID NO: 41577 - DNA, 23 bp, Homo sapiens
tgtaggggaggttgggccaggga

SEQ ID NO: 41578 - DNA, 20 bp, Homo sapiens
taggggaggttgggccaggg

SEQ ID NO: 41579 - DNA, 24 bp, Homo sapiens
tctgcactgtgagttggctggctg

SEQ ID NO: 41580 - DNA, 22 bp, Homo sapiens
ctgcactgtgagttggctggct

SEQ ID NO: 41581 - DNA, 22 bp, Homo sapiens
tctgcactgtgagttggctggc

SEQ ID NO: 41582 - DNA, 21 bp, Homo sapiens
tctgcactgtgagttggctgg

SEQ ID NO: 41583 - DNA, 20 bp, Homo sapiens
tctgcactgtgagttggctg

SEQ ID NO: 41584 - DNA, 19 bp, Homo sapiens
cacagggcagagggaggcc

SEQ ID NO: 41585 - DNA, 28 bp, Homo sapiens
catcctgctccacagggcagagggaggc

SEQ ID NO: 41586 - DNA, 23 bp, Homo sapiens
acatcctgctccacagggcagag

SEQ ID NO: 41587 - DNA, 22 bp, Homo sapiens
acatcctgctccacagggcaga

SEQ ID NO: 41588 - DNA, 19 bp, Homo sapiens
acatcctgctccacagggc

SEQ ID NO: 41589 - DNA, 24 bp, Homo sapiens
atcgggaatgtcgtgtccgcccag

SEQ ID NO: 41590 - DNA, 23 bp, Homo sapiens
atcgggaatgtcgtgtccgccca

SEQ ID NO: 41591 - DNA, 23 bp, Homo sapiens
catcgggaatgtcgtgtccgccc

SEQ ID NO: 41592 - DNA, 21 bp, Homo sapiens
atcgggaatgtcgtgtccgcc

SEQ ID NO: 41593 - DNA, 22 bp, Homo sapiens
catcgggaatgtcgtgtccgcc

SEQ ID NO: 41594 - DNA, 20 bp, Homo sapiens
atcgggaatgtcgtgtccgc

SEQ ID NO: 41595 - DNA, 21 bp, Homo sapiens
catcgggaatgtcgtgtccgc

SEQ ID NO: 41596 - DNA, 22 bp, Homo sapiens
ccatcgggaatgtcgtgtccgc

SEQ ID NO: 41597 - DNA, 19 bp, Homo sapiens
atcgggaatgtcgtgtccg

SEQ ID NO: 41598 - DNA, 20 bp, Homo sapiens
catcgggaatgtcgtgtccg

SEQ ID NO: 41599 - DNA, 18 bp, Homo sapiens
atcgggaatgtcgtgtcc

SEQ ID NO: 41600 - DNA, 19 bp, Homo sapiens
catcgggaatgtcgtgtcc

SEQ ID NO: 41601 - DNA, 17 bp, Homo sapiens
atcgggaatgtcgtgtc

SEQ ID NO: 41602 - DNA, 18 bp, Homo sapiens
catcgggaatgtcgtgtc

SEQ ID NO: 41603 - DNA, 17 bp, Homo sapiens
catcgggaatgtcgtgt

SEQ ID NO: 41604 - DNA, 16 bp, Homo sapiens
catcgggaatgtcgtg

SEQ ID NO: 41605 - DNA, 26 bp, Homo sapiens
atgacacgatcactcccgttgagtgg

SEQ ID NO: 41606 - DNA, 25 bp, Homo sapiens
aatgacacgatcactcccgttgagt

SEQ ID NO: 41607 - DNA, 24 bp, Homo sapiens
aatgacacgatcactcccgttgag

SEQ ID NO: 41608 - DNA, 22 bp, Homo sapiens
atgacacgatcactcccgttga

SEQ ID NO: 41609 - DNA, 22 bp, Homo sapiens
aatgacacgatcactcccgttg

SEQ ID NO: 41610 - DNA, 21 bp, Homo sapiens
aatgacacgatcactcccgtt

SEQ ID NO: 41611 - DNA, 20 bp, Homo sapiens
aatgacacgatcactcccgt

SEQ ID NO: 41612 - DNA, 19 bp, Homo sapiens
aatgacacgatcactcccg

SEQ ID NO: 41613 - DNA, 18 bp, Homo sapiens
aatgacacgatcactccc

SEQ ID NO: 41614 - DNA, 24 bp, Homo sapiens
ctgcgcttggatttcgtcccctgc

SEQ ID NO: 41615 - DNA, 23 bp, Homo sapiens
ctgcgcttggatttcgtcccctg

SEQ ID NO: 41616 - DNA, 22 bp, Homo sapiens
ctgcgcttggatttcgtcccct

SEQ ID NO: 41617 - DNA, 23 bp, Homo sapiens
gctgcgcttggatttcgtcccct

SEQ ID NO: 41618 - DNA, 21 bp, Homo sapiens
ctgcgcttggatttcgtcccc

SEQ ID NO: 41619 - DNA, 20 bp, Homo sapiens
ctgcgcttggatttcgtccc

SEQ ID NO: 41620 - DNA, 21 bp, Homo sapiens
gctgcgcttggatttcgtccc

SEQ ID NO: 41621 - DNA, 19 bp, Homo sapiens
ctgcgcttggatttcgtcc

SEQ ID NO: 41622 - DNA, 20 bp, Homo sapiens
gctgcgcttggatttcgtcc

SEQ ID NO: 41623 - DNA, 19 bp, Homo sapiens
gctgcgcttggatttcgtc

SEQ ID NO: 41624 - DNA, 17 bp, Homo sapiens
ctgcgcttggatttcgt

SEQ ID NO: 41625 - DNA, 26 bp, Homo sapiens
caacggaatcccaaaagcagctgttg

SEQ ID NO: 41626 - DNA, 25 bp, Homo sapiens
caacggaatcccaaaagcagctgtt

SEQ ID NO: 41627 - DNA, 24 bp, Homo sapiens
caacggaatcccaaaagcagctgt

SEQ ID NO: 41628 - DNA, 22 bp, Homo sapiens
aacggaatcccaaaagcagctg

SEQ ID NO: 41629 - DNA, 22 bp, Homo sapiens
caacggaatcccaaaagcagct

SEQ ID NO: 41630 - DNA, 21 bp, Homo sapiens
caacggaatcccaaaagcagc

SEQ ID NO: 41631 - DNA, 20 bp, Homo sapiens
caacggaatcccaaaagcag

SEQ ID NO: 41632 - DNA, 19 bp, Homo sapiens
caacggaatcccaaaagca

SEQ ID NO: 41633 - DNA, 23 bp, Homo sapiens
ccactgcctatgccccacaggtg

SEQ ID NO: 41634 - DNA, 22 bp, Homo sapiens
ccactgcctatgccccacaggt

SEQ ID NO: 41635 - DNA, 23 bp, Homo sapiens
cccactgcctatgccccacaggt

SEQ ID NO: 41636 - DNA, 22 bp, Homo sapiens
cccactgcctatgccccacagg

SEQ ID NO: 41637 - DNA, 21 bp, Homo sapiens
cccactgcctatgccccacag

SEQ ID NO: 41638 - DNA, 27 bp, Homo sapiens
catggggtagggcagagtagggctgga

SEQ ID NO: 41639 - DNA, 26 bp, Homo sapiens
ccatggggtagggcagagtagggctg

SEQ ID NO: 41640 - DNA, 23 bp, Homo sapiens
atggggtagggcagagtagggct

SEQ ID NO: 41641 - DNA, 24 bp, Homo sapiens
catggggtagggcagagtagggct

SEQ ID NO: 41642 - DNA, 22 bp, Homo sapiens
atggggtagggcagagtagggc

SEQ ID NO: 41643 - DNA, 23 bp, Homo sapiens
catggggtagggcagagtagggc

SEQ ID NO: 41644 - DNA, 22 bp, Homo sapiens
catggggtagggcagagtaggg

SEQ ID NO: 41645 - DNA, 20 bp, Homo sapiens
atggggtagggcagagtagg

SEQ ID NO: 41646 - DNA, 22 bp, Homo sapiens
ccatggggtagggcagagtagg

SEQ ID NO: 41647 - DNA, 20 bp, Homo sapiens
catggggtagggcagagtag

SEQ ID NO: 41648 - DNA, 21 bp, Homo sapiens
ggccatggggtagggcagagt

SEQ ID NO: 41649 - DNA, 22 bp, Homo sapiens
tctacctcatcccagttccatc

SEQ ID NO: 41650 - DNA, 25 bp, Homo sapiens
tcctctacctcatcccagttccatc

SEQ ID NO: 41651 - DNA, 24 bp, Homo sapiens
tcctctacctcatcccagttccat

SEQ ID NO: 41652 - DNA, 27 bp, Homo sapiens
tcctcctctacctcatcccagttccat

SEQ ID NO: 41653 - DNA, 23 bp, Homo sapiens
tcctctacctcatcccagttcca

SEQ ID NO: 41654 - DNA, 22 bp, Homo sapiens
tcctctacctcatcccagttcc

SEQ ID NO: 41655 - DNA, 21 bp, Homo sapiens
tcctctacctcatcccagttc

SEQ ID NO: 41656 - DNA, 22 bp, Homo sapiens
ctcctctacctcatcccagttc

SEQ ID NO: 41657 - DNA, 23 bp, Homo sapiens
cctcctctacctcatcccagttc

SEQ ID NO: 41658 - DNA, 24 bp, Homo sapiens
tcctcctctacctcatcccagttc

SEQ ID NO: 41659 - DNA, 21 bp, Homo sapiens
ctcctctacctcatcccagtt

SEQ ID NO: 41660 - DNA, 22 bp, Homo sapiens
cctcctctacctcatcccagtt

SEQ ID NO: 41661 - DNA, 23 bp, Homo sapiens
tcctcctctacctcatcccagtt

SEQ ID NO: 41662 - DNA, 21 bp, Homo sapiens
cctcctctacctcatcccagt

SEQ ID NO: 41663 - DNA, 23 bp, Homo sapiens
ctcctcctctacctcatcccagt

SEQ ID NO: 41664 - DNA, 21 bp, Homo sapiens
tcctcctctacctcatcccag

SEQ ID NO: 41665 - DNA, 19 bp, Homo sapiens
cctcctctacctcatccca

SEQ ID NO: 41666 - DNA, 20 bp, Homo sapiens
tcctcctctacctcatccca

SEQ ID NO: 41667 - DNA, 19 bp, Homo sapiens
tcctcctctacctcatccc

SEQ ID NO: 41668 - DNA, 25 bp, Homo sapiens
tctgactcctcctctacctcatccc

SEQ ID NO: 41669 - DNA, 19 bp, Homo sapiens
aggcgggggctggggcgcg

SEQ ID NO: 41670 - DNA, 16 bp, Homo sapiens
cgtgggtctcgcatca

SEQ ID NO: 41671 - DNA, 18 bp, Homo sapiens
cgtgggtctcgcatcagg

SEQ ID NO: 41672 - DNA, 21 bp, Homo sapiens
ggtctcgcatcaggaggcaag

SEQ ID NO: 41673 - DNA, 19 bp, Homo sapiens
tctcgcatcaggaggcaag

SEQ ID NO: 41674 - DNA, 21 bp, Homo sapiens
tctcgcatcaggaggcaaggc

SEQ ID NO: 41675 - DNA, 22 bp, Homo sapiens
tctcgcatcaggaggcaaggcc

SEQ ID NO: 41676 - DNA, 23 bp, Homo sapiens
tctcgcatcaggaggcaaggcca

SEQ ID NO: 41677 - DNA, 24 bp, Homo sapiens
tctcgcatcaggaggcaaggccag

SEQ ID NO: 41678 - DNA, 25 bp, Homo sapiens
tctcgcatcaggaggcaaggccagg

SEQ ID NO: 41679 - DNA, 20 bp, Homo sapiens
acccatgcctcctgccgcgg

SEQ ID NO: 41680 - DNA, 23 bp, Homo sapiens
acccatgcctcctgccgcggtca

SEQ ID NO: 41681 - DNA, 20 bp, Homo sapiens
cccatgcctcctgccgcggt

SEQ ID NO: 41682 - DNA, 22 bp, Homo sapiens
cccatgcctcctgccgcggtca

SEQ ID NO: 41683 - DNA, 22 bp, Homo sapiens
catgcctcctgccgcggtcaga

SEQ ID NO: 41684 - DNA, 21 bp, Homo sapiens
atgcctcctgccgcggtcaga

SEQ ID NO: 41685 - DNA, 23 bp, Homo sapiens
atgcctcctgccgcggtcagagc

SEQ ID NO: 41686 - DNA, 21 bp, Homo sapiens
gcgggggtggcggcggcatcc

SEQ ID NO: 41687 - DNA, 24 bp, Homo sapiens
gcgggggtggcggcggcatcccgg

SEQ ID NO: 41688 - DNA, 18 bp, Homo sapiens
gggggtggcggcggcatc

SEQ ID NO: 41689 - DNA, 17 bp, Homo sapiens
ggggtggcggcggcatc

SEQ ID NO: 41690 - DNA, 16 bp, Homo sapiens
gggtggcggcggcatc

SEQ ID NO: 41691 - DNA, 16 bp, Homo sapiens
gcggcggcatcccgga

SEQ ID NO: 41692 - DNA, 16 bp, Homo sapiens
cggcggcatcccggac

SEQ ID NO: 41693 - DNA, 17 bp, Homo sapiens
gatgcgccgcccactgc

SEQ ID NO: 41694 - DNA, 18 bp, Homo sapiens
gatgcgccgcccactgcc

SEQ ID NO: 41695 - DNA, 19 bp, Homo sapiens
gatgcgccgcccactgccc

SEQ ID NO: 41696 - DNA, 20 bp, Homo sapiens
gatgcgccgcccactgcccc

SEQ ID NO: 41697 - DNA, 21 bp, Homo sapiens
gatgcgccgcccactgccccg

SEQ ID NO: 41698 - DNA, 22 bp, Homo sapiens
gatgcgccgcccactgccccgc

SEQ ID NO: 41699 - DNA, 23 bp, Homo sapiens
gatgcgccgcccactgccccgcg

SEQ ID NO: 41700 - DNA, 25 bp, Homo sapiens
gatgcgccgcccactgccccgcgcc

SEQ ID NO: 41701 - DNA, 18 bp, Homo sapiens
gcgccgcccactgccccg

SEQ ID NO: 41702 - DNA, 19 bp, Homo sapiens
gcgccgcccactgccccgc

SEQ ID NO: 41703 - DNA, 26 bp, Homo sapiens
ctgtacaggccactgccttgccagga

SEQ ID NO: 41704 - DNA, 27 bp, Homo sapiens
actgtacaggccactgccttgccagga

SEQ ID NO: 41705 - DNA, 25 bp, Homo sapiens
ctgtacaggccactgccttgccagg

SEQ ID NO: 41706 - DNA, 24 bp, Homo sapiens
ctgtacaggccactgccttgccag

SEQ ID NO: 41707 - DNA, 23 bp, Homo sapiens
ctgtacaggccactgccttgcca

SEQ ID NO: 41708 - DNA, 24 bp, Homo sapiens
actgtacaggccactgccttgcca

SEQ ID NO: 41709 - DNA, 22 bp, Homo sapiens
ctgtacaggccactgccttgcc

SEQ ID NO: 41710 - DNA, 22 bp, Homo sapiens
actgtacaggccactgccttgc

SEQ ID NO: 41711 - DNA, 23 bp, Homo sapiens
aactgtacaggccactgccttgc

SEQ ID NO: 41712 - DNA, 20 bp, Homo sapiens
ctgtacaggccactgccttg

SEQ ID NO: 41713 - DNA, 19 bp, Homo sapiens
ctgtacaggccactgcctt

SEQ ID NO: 41714 - DNA, 21 bp, Homo sapiens
aactgtacaggccactgcctt

SEQ ID NO: 41715 - DNA, 27 bp, Homo sapiens
tgaggtagtagtttgtacagtttgagg

SEQ ID NO: 41716 - DNA, 26 bp, Homo sapiens
tgaggtagtagtttgtacagtttgag

SEQ ID NO: 41717 - DNA, 24 bp, Homo sapiens
tgaggtagtagtttgtacagtttg

SEQ ID NO: 41718 - DNA, 23 bp, Homo sapiens
tgaggtagtagtttgtacagttt

SEQ ID NO: 41719 - DNA, 21 bp, Homo sapiens
tgaggtagtagtttgtacagt

SEQ ID NO: 41720 - DNA, 22 bp, Homo sapiens
ctgaggtagtagtttgtacagt

SEQ ID NO: 41721 - DNA, 20 bp, Homo sapiens
tgaggtagtagtttgtacag

SEQ ID NO: 41722 - DNA, 24 bp, Homo sapiens
tatagggattggagccgtggcgca

SEQ ID NO: 41723 - DNA, 23 bp, Homo sapiens
tatagggattggagccgtggcgc

SEQ ID NO: 41724 - DNA, 24 bp, Homo sapiens
atatagggattggagccgtggcgc

SEQ ID NO: 41725 - DNA, 23 bp, Homo sapiens
atatagggattggagccgtggcg

SEQ ID NO: 41726 - DNA, 21 bp, Homo sapiens
tatagggattggagccgtggc

SEQ ID NO: 41727 - DNA, 22 bp, Homo sapiens
atatagggattggagccgtggc

SEQ ID NO: 41728 - DNA, 20 bp, Homo sapiens
tatagggattggagccgtgg

SEQ ID NO: 41729 - DNA, 21 bp, Homo sapiens
atatagggattggagccgtgg

SEQ ID NO: 41730 - DNA, 27 bp, Homo sapiens
atggctttttattcctatgtgattcta

SEQ ID NO: 41731 - DNA, 28 bp, Homo sapiens
tatggctttttattcctatgtgattcta

SEQ ID NO: 41732 - DNA, 27 bp, Homo sapiens
tatggctttttattcctatgtgattct

SEQ ID NO: 41733 - DNA, 24 bp, Homo sapiens
tggctttttattcctatgtgattc

SEQ ID NO: 41734 - DNA, 26 bp, Homo sapiens
tatggctttttattcctatgtgattc

SEQ ID NO: 41735 - DNA, 25 bp, Homo sapiens
tatggctttttattcctatgtgatt

SEQ ID NO: 41736 - DNA, 26 bp, Homo sapiens
ctatggctttttattcctatgtgatt

SEQ ID NO: 41737 - DNA, 24 bp, Homo sapiens
ctatggctttttattcctatgtga

SEQ ID NO: 41738 - DNA, 22 bp, Homo sapiens
tatggctttttattcctatgtg

SEQ ID NO: 41739 - DNA, 23 bp, Homo sapiens
ctatggctttttattcctatgtg

SEQ ID NO: 41740 - DNA, 21 bp, Homo sapiens
tatggctttttattcctatgt

SEQ ID NO: 41741 - DNA, 20 bp, Homo sapiens
tatggctttttattcctatg

SEQ ID NO: 41742 - DNA, 18 bp, Homo sapiens
gagcgagcggacatcctt

SEQ ID NO: 41743 - DNA, 19 bp, Homo sapiens
tgagcgagcggacatcctt

SEQ ID NO: 41744 - DNA, 20 bp, Homo sapiens
ctgagcgagcggacatcctt

SEQ ID NO: 41745 - DNA, 19 bp, Homo sapiens
cactgagcgagcggacatc

SEQ ID NO: 41746 - DNA, 23 bp, Homo sapiens
aaacatgaatggtaaagcgatgt

SEQ ID NO: 41747 - DNA, 22 bp, Homo sapiens
aaacatgaatggtaaagcgatg

SEQ ID NO: 41748 - DNA, 22 bp, Homo sapiens
atcgctttaccattcatgttca

SEQ ID NO: 41749 - DNA, 21 bp, Homo sapiens
atcgctttaccattcatgttc

SEQ ID NO: 41750 - DNA, 22 bp, Homo sapiens
catcgctttaccattcatgttc

SEQ ID NO: 41751 - DNA, 22 bp, Homo sapiens
attcccttgtagataacccggt

SEQ ID NO: 41752 - DNA, 23 bp, Homo sapiens
aattcccttgtagataacccggt

SEQ ID NO: 41753 - DNA, 18 bp, Homo sapiens
cccttgtagataacccgg

SEQ ID NO: 41754 - DNA, 21 bp, Homo sapiens
attcccttgtagataacccgg

SEQ ID NO: 41755 - DNA, 21 bp, Homo sapiens
aattcccttgtagataacccg

SEQ ID NO: 41756 - DNA, 19 bp, Homo sapiens
agcattcaactagtgattg

SEQ ID NO: 41757 - DNA, 20 bp, Homo sapiens
agcattcaactagtgattgt

SEQ ID NO: 41758 - DNA, 21 bp, Homo sapiens
agcattcaactagtgattgtg

SEQ ID NO: 41759 - DNA, 22 bp, Homo sapiens
agcattcaactagtgattgtgt

SEQ ID NO: 41760 - DNA, 23 bp, Homo sapiens
agcattcaactagtgattgtgtt

SEQ ID NO: 41761 - DNA, 24 bp, Homo sapiens
agcattcaactagtgattgtgtta

SEQ ID NO: 41762 - DNA, 22 bp, Homo sapiens
cattcaactagtgattgtgtta

SEQ ID NO: 41763 - DNA, 23 bp, Homo sapiens
caacctattcagttagttccata

SEQ ID NO: 41764 - DNA, 28 bp, Homo sapiens
catggcccaacctattcagttagttcca

SEQ ID NO: 41765 - DNA, 24 bp, Homo sapiens
tggcccaacctattcagttagttc

SEQ ID NO: 41766 - DNA, 22 bp, Homo sapiens
ggcccaacctattcagttagtt

SEQ ID NO: 41767 - DNA, 23 bp, Homo sapiens
tggcccaacctattcagttagtt

SEQ ID NO: 41768 - DNA, 21 bp, Homo sapiens
ggcccaacctattcagttagt

SEQ ID NO: 41769 - DNA, 21 bp, Homo sapiens
tggcccaacctattcagttag

SEQ ID NO: 41770 - DNA, 19 bp, Homo sapiens
tggcccaacctattcagtt

SEQ ID NO: 41771 - DNA, 27 bp, Homo sapiens
ctgactgaataggtagggtcatttttc

SEQ ID NO: 41772 - DNA, 25 bp, Homo sapiens
ctgactgaataggtagggtcatttt

SEQ ID NO: 41773 - DNA, 24 bp, Homo sapiens
ctgactgaataggtagggtcattt

SEQ ID NO: 41774 - DNA, 22 bp, Homo sapiens
tgactgaataggtagggtcatt

SEQ ID NO: 41775 - DNA, 22 bp, Homo sapiens
ctgactgaataggtagggtcat

SEQ ID NO: 41776 - DNA, 21 bp, Homo sapiens
ctgactgaataggtagggtca

SEQ ID NO: 41777 - DNA, 20 bp, Homo sapiens
ctgactgaataggtagggtc

SEQ ID NO: 41778 - DNA, 19 bp, Homo sapiens
ctgactgaataggtagggt

SEQ ID NO: 41779 - DNA, 18 bp, Homo sapiens
ctgactgaataggtaggg

SEQ ID NO: 41780 - DNA, 17 bp, Homo sapiens
ctgactgaataggtagg

SEQ ID NO: 41781 - DNA, 21 bp, Homo sapiens
tatacagaccctggcttttct

SEQ ID NO: 41782 - DNA, 22 bp, Homo sapiens
ctatacagaccctggcttttct

SEQ ID NO: 41783 - DNA, 23 bp, Homo sapiens
tctatacagaccctggcttttct

SEQ ID NO: 41784 - DNA, 21 bp, Homo sapiens
ctatacagaccctggcttttc

SEQ ID NO: 41785 - DNA, 20 bp, Homo sapiens
ctatacagaccctggctttt

SEQ ID NO: 41786 - DNA, 21 bp, Homo sapiens
tctatacagaccctggctttt

SEQ ID NO: 41787 - DNA, 20 bp, Homo sapiens
tctatacagaccctggcttt

SEQ ID NO: 41788 - DNA, 19 bp, Homo sapiens
tctatacagaccctggctt

SEQ ID NO: 41789 - DNA, 17 bp, Homo sapiens
tctatacagaccctggc

SEQ ID NO: 41790 - DNA, 21 bp, Homo sapiens
gtgtgtgttctctgatggaca

SEQ ID NO: 41791 - DNA, 22 bp, Homo sapiens
gtgtgtgttctctgatggacag

SEQ ID NO: 41792 - DNA, 23 bp, Homo sapiens
gtgtgtgttctctgatggacagt

SEQ ID NO: 41793 - DNA, 21 bp, Homo sapiens
aactagtaatgttggattagg

SEQ ID NO: 41794 - DNA, 23 bp, Homo sapiens
aactagtaatgttggattagggc

SEQ ID NO: 41795 - DNA, 25 bp, Homo sapiens
aactagtaatgttggattagggctc

SEQ ID NO: 41796 - DNA, 28 bp, Homo sapiens
aactagtaatgttggattagggctcact

SEQ ID NO: 41797 - DNA, 20 bp, Homo sapiens
taacaaacacctgtaaaaca

SEQ ID NO: 41798 - DNA, 21 bp, Homo sapiens
taacaaacacctgtaaaacag

SEQ ID NO: 41799 - DNA, 23 bp, Homo sapiens
taacaaacacctgtaaaacagca

SEQ ID NO: 41800 - DNA, 23 bp, Homo sapiens
atgtcaatattattagccacttc

SEQ ID NO: 41801 - DNA, 22 bp, Homo sapiens
atgtcaatattattagccactt

SEQ ID NO: 41802 - DNA, 21 bp, Homo sapiens
atgtcaatattattagccact

SEQ ID NO: 41803 - DNA, 20 bp, Homo sapiens
atgtcaatattattagccac

SEQ ID NO: 41804 - DNA, 19 bp, Homo sapiens
atgtcaatattattagcca

SEQ ID NO: 41805 - DNA, 18 bp, Homo sapiens
atgtcaatattattagcc

SEQ ID NO: 41806 - DNA, 22 bp, Homo sapiens
tggctaataatattgacactat

SEQ ID NO: 41807 - DNA, 21 bp, Homo sapiens
tggctaataatattgacacta

SEQ ID NO: 41808 - DNA, 20 bp, Homo sapiens
tggctaataatattgacact

SEQ ID NO: 41809 - DNA, 21 bp, Homo sapiens
gtggctaataatattgacact

SEQ ID NO: 41810 - DNA, 22 bp, Homo sapiens
agtggctaataatattgacact

SEQ ID NO: 41811 - DNA, 21 bp, Homo sapiens
agtggctaataatattgacac

SEQ ID NO: 41812 - DNA, 21 bp, Homo sapiens
aagtggctaataatattgaca

SEQ ID NO: 41813 - DNA, 21 bp, Homo sapiens
tctgagtaccatatgccttgt

SEQ ID NO: 41814 - DNA, 19 bp, Homo sapiens
cctaagtctctgagtacca

SEQ ID NO: 41815 - DNA, 23 bp, Homo sapiens
agtgaggtagagggagtgccgag

SEQ ID NO: 41816 - DNA, 25 bp, Homo sapiens
acagtgaggtagagggagtgccgag

SEQ ID NO: 41817 - DNA, 24 bp, Homo sapiens
acagtgaggtagagggagtgccga

SEQ ID NO: 41818 - DNA, 22 bp, Homo sapiens
cagtgaggtagagggagtgccg

SEQ ID NO: 41819 - DNA, 23 bp, Homo sapiens
acagtgaggtagagggagtgccg

SEQ ID NO: 41820 - DNA, 22 bp, Homo sapiens
acagtgaggtagagggagtgcc

SEQ ID NO: 41821 - DNA, 23 bp, Homo sapiens
gacagtgaggtagagggagtgcc

SEQ ID NO: 41822 - DNA, 21 bp, Homo sapiens
acagtgaggtagagggagtgc

SEQ ID NO: 41823 - DNA, 22 bp, Homo sapiens
gacagtgaggtagagggagtgc

SEQ ID NO: 41824 - DNA, 23 bp, Homo sapiens
ggacagtgaggtagagggagtgc

SEQ ID NO: 41825 - DNA, 24 bp, Homo sapiens
tggacagtgaggtagagggagtgc

SEQ ID NO: 41826 - DNA, 20 bp, Homo sapiens
acagtgaggtagagggagtg

SEQ ID NO: 41827 - DNA, 21 bp, Homo sapiens
gacagtgaggtagagggagtg

SEQ ID NO: 41828 - DNA, 22 bp, Homo sapiens
ggacagtgaggtagagggagtg

SEQ ID NO: 41829 - DNA, 25 bp, Homo sapiens
tgtggacagtgaggtagagggagtg

SEQ ID NO: 41830 - DNA, 20 bp, Homo sapiens
gacagtgaggtagagggagt

SEQ ID NO: 41831 - DNA, 23 bp, Homo sapiens
gtggacagtgaggtagagggagt

SEQ ID NO: 41832 - DNA, 23 bp, Homo sapiens
tgtggacagtgaggtagagggag

SEQ ID NO: 41833 - DNA, 22 bp, Homo sapiens
tgtggacagtgaggtagaggga

SEQ ID NO: 41834 - DNA, 21 bp, Homo sapiens
tgtggacagtgaggtagaggg

SEQ ID NO: 41835 - DNA, 20 bp, Homo sapiens
tgtggacagtgaggtagagg

SEQ ID NO: 41836 - DNA, 19 bp, Homo sapiens
tgtggacagtgaggtagag

SEQ ID NO: 41837 - DNA, 18 bp, Homo sapiens
tgtggacagtgaggtaga

SEQ ID NO: 41838 - DNA, 27 bp, Homo sapiens
acaatgtgatcttttggatgtagggca

SEQ ID NO: 41839 - DNA, 26 bp, Homo sapiens
aggatgagcaaagaaagtagattttt

SEQ ID NO: 41840 - DNA, 25 bp, Homo sapiens
aggatgagcaaagaaagtagatttt

SEQ ID NO: 41841 - DNA, 24 bp, Homo sapiens
aggatgagcaaagaaagtagattt

SEQ ID NO: 41842 - DNA, 22 bp, Homo sapiens
aggatgagcaaagaaagtagat

SEQ ID NO: 41843 - DNA, 21 bp, Homo sapiens
aggatgagcaaagaaagtaga

SEQ ID NO: 41844 - DNA, 23 bp, Homo sapiens
attctaatttctccacgtctttg

SEQ ID NO: 41845 - DNA, 24 bp, Homo sapiens
attctaatttctccacgtctttgg

SEQ ID NO: 41846 - DNA, 25 bp, Homo sapiens
attctaatttctccacgtctttggt

SEQ ID NO: 41847 - DNA, 18 bp, Homo sapiens
ttggcaaagatgtggaaa

SEQ ID NO: 41848 - DNA, 21 bp, Homo sapiens
ttggcaaagatgtggaaaaat

SEQ ID NO: 41849 - DNA, 28 bp, Homo sapiens
aagatgtggaaaaattggaatcctcatt

SEQ ID NO: 41850 - DNA, 24 bp, Homo sapiens
aattgcactttagcaatggtgatg

SEQ ID NO: 41851 - DNA, 23 bp, Homo sapiens
aattgcactttagcaatggtgat

SEQ ID NO: 41852 - DNA, 21 bp, Homo sapiens
attgcactttagcaatggtga

SEQ ID NO: 41853 - DNA, 21 bp, Homo sapiens
aattgcactttagcaatggtg

SEQ ID NO: 41854 - DNA, 20 bp, Homo sapiens
aattgcactttagcaatggt

SEQ ID NO: 41855 - DNA, 24 bp, Homo sapiens
taagtgcttccatgtttgagtgtg

SEQ ID NO: 41856 - DNA, 21 bp, Homo sapiens
agtgcttccatgtttgagtgt

SEQ ID NO: 41857 - DNA, 22 bp, Homo sapiens
aagtgcttccatgtttgagtgt

SEQ ID NO: 41858 - DNA, 22 bp, Homo sapiens
taagtgcttccatgtttgagtg

SEQ ID NO: 41859 - DNA, 21 bp, Homo sapiens
taagtgcttccatgtttgagt

SEQ ID NO: 41860 - DNA, 19 bp, Homo sapiens
taagtgcttccatgtttga

SEQ ID NO: 41861 - DNA, 23 bp, Homo sapiens
actttaacatggaggcacttgct

SEQ ID NO: 41862 - DNA, 23 bp, Homo sapiens
tactttaacatggaggcacttgc

SEQ ID NO: 41863 - DNA, 21 bp, Homo sapiens
actttaacatggaggcacttg

SEQ ID NO: 41864 - DNA, 24 bp, Homo sapiens
aagtgcttccatgttttggtgatg

SEQ ID NO: 41865 - DNA, 25 bp, Homo sapiens
taagtgcttccatgttttggtgatg

SEQ ID NO: 41866 - DNA, 23 bp, Homo sapiens
aagtgcttccatgttttggtgat

SEQ ID NO: 41867 - DNA, 24 bp, Homo sapiens
taagtgcttccatgttttggtgat

SEQ ID NO: 41868 - DNA, 22 bp, Homo sapiens
aagtgcttccatgttttggtga

SEQ ID NO: 41869 - DNA, 22 bp, Homo sapiens
taagtgcttccatgttttggtg

SEQ ID NO: 41870 - DNA, 21 bp, Homo sapiens
taagtgcttccatgttttggt

SEQ ID NO: 41871 - DNA, 28 bp, Homo sapiens
cttaaacgtggatgtacttgctttgaaa

SEQ ID NO: 41872 - DNA, 24 bp, Homo sapiens
taaacgtggatgtacttgctttga

SEQ ID NO: 41873 - DNA, 23 bp, Homo sapiens
taaacgtggatgtacttgctttg

SEQ ID NO: 41874 - DNA, 21 bp, Homo sapiens
aaacgtggatgtacttgcttt

SEQ ID NO: 41875 - DNA, 22 bp, Homo sapiens
taaacgtggatgtacttgcttt

SEQ ID NO: 41876 - DNA, 21 bp, Homo sapiens
taaacgtggatgtacttgctt

SEQ ID NO: 41877 - DNA, 17 bp, Homo sapiens
acgtggatgtacttgct

SEQ ID NO: 41878 - DNA, 22 bp, Homo sapiens
cttaaacgtggatgtacttgct

SEQ ID NO: 41879 - DNA, 22 bp, Homo sapiens
acttaaacgtggatgtacttgc

SEQ ID NO: 41880 - DNA, 22 bp, Homo sapiens
agtgcttccatgtttcagtgga

SEQ ID NO: 41881 - DNA, 23 bp, Homo sapiens
aagtgcttccatgtttcagtgga

SEQ ID NO: 41882 - DNA, 22 bp, Homo sapiens
aagtgcttccatgtttcagtgg

SEQ ID NO: 41883 - DNA, 22 bp, Homo sapiens
taagtgcttccatgtttcagtg

SEQ ID NO: 41884 - DNA, 24 bp, Homo sapiens
agtaagtgcttccatgtttcagtg

SEQ ID NO: 41885 - DNA, 21 bp, Homo sapiens
taagtgcttccatgtttcagt

SEQ ID NO: 41886 - DNA, 22 bp, Homo sapiens
gtaagtgcttccatgtttcagt

SEQ ID NO: 41887 - DNA, 23 bp, Homo sapiens
tttaacatgggggtacctgctgt

SEQ ID NO: 41888 - DNA, 21 bp, Homo sapiens
tttaacatgggggtacctgct

SEQ ID NO: 41889 - DNA, 20 bp, Homo sapiens
tttaacatgggggtacctgc

SEQ ID NO: 41890 - DNA, 22 bp, Homo sapiens
gctttaacatgggggtacctgc

SEQ ID NO: 41891 - DNA, 21 bp, Homo sapiens
gctttaacatgggggtacctg

SEQ ID NO: 41892 - DNA, 23 bp, Homo sapiens
aagtgcttccatgttttagtagg

SEQ ID NO: 41893 - DNA, 24 bp, Homo sapiens
taagtgcttccatgttttagtagg

SEQ ID NO: 41894 - DNA, 22 bp, Homo sapiens
aagtgcttccatgttttagtag

SEQ ID NO: 41895 - DNA, 22 bp, Homo sapiens
taagtgcttccatgttttagta

SEQ ID NO: 41896 - DNA, 20 bp, Homo sapiens
aagtgcttccatgttttagt

SEQ ID NO: 41897 - DNA, 21 bp, Homo sapiens
taagtgcttccatgttttagt

SEQ ID NO: 41898 - DNA, 23 bp, Homo sapiens
actttaacatggaagtgctttct

SEQ ID NO: 41899 - DNA, 16 bp, Homo sapiens
actttaacatggaagt

SEQ ID NO: 41900 - DNA, 21 bp, Homo sapiens
aaactggatcaattataggag

SEQ ID NO: 41901 - DNA, 22 bp, Homo sapiens
aaactggatcaattataggagt

SEQ ID NO: 41902 - DNA, 19 bp, Homo sapiens
aactggatcaattatagga

SEQ ID NO: 41903 - DNA, 21 bp, Homo sapiens
aactggatcaattataggagt

SEQ ID NO: 41904 - DNA, 23 bp, Homo sapiens
aactggatcaattataggagtga

SEQ ID NO: 41905 - DNA, 22 bp, Homo sapiens
actggatcaattataggagtga

SEQ ID NO: 41906 - DNA, 24 bp, Homo sapiens
actggatcaattataggagtgaaa

SEQ ID NO: 41907 - DNA, 20 bp, Homo sapiens
ctggatcaattataggagtg

SEQ ID NO: 41908 - DNA, 19 bp, Homo sapiens
gtagataaaatattggtac

SEQ ID NO: 41909 - DNA, 20 bp, Homo sapiens
gtagataaaatattggtacc

SEQ ID NO: 41910 - DNA, 21 bp, Homo sapiens
gtagataaaatattggtacct

SEQ ID NO: 41911 - DNA, 22 bp, Homo sapiens
gtagataaaatattggtacctg

SEQ ID NO: 41912 - DNA, 23 bp, Homo sapiens
gtagataaaatattggtacctga

SEQ ID NO: 41913 - DNA, 24 bp, Homo sapiens
gtagataaaatattggtacctgat

SEQ ID NO: 41914 - DNA, 25 bp, Homo sapiens
gtagataaaatattggtacctgatg

SEQ ID NO: 41915 - DNA, 20 bp, Homo sapiens
tagataaaatattggtacct

SEQ ID NO: 41916 - DNA, 22 bp, Homo sapiens
tagataaaatattggtacctga

SEQ ID NO: 41917 - DNA, 19 bp, Homo sapiens
agataaaatattggtacct

SEQ ID NO: 41918 - DNA, 22 bp, Homo sapiens
agataaaatattggtacctgat

SEQ ID NO: 41919 - DNA, 21 bp, Homo sapiens
ataaaatattggtacctgatg

SEQ ID NO: 41920 - DNA, 23 bp, Homo sapiens
accgtgcaaaggtagcataatcg

SEQ ID NO: 41921 - DNA, 24 bp, Homo sapiens
accgtgcaaaggtagcataatcgc

SEQ ID NO: 41922 - DNA, 25 bp, Homo sapiens
accgtgcaaaggtagcataatcgct

SEQ ID NO: 41923 - DNA, 22 bp, Homo sapiens
ccgtgcaaaggtagcataatcg

SEQ ID NO: 41924 - DNA, 24 bp, Homo sapiens
ccgtgcaaaggtagcataatcgct

SEQ ID NO: 41925 - DNA, 21 bp, Homo sapiens
cgtgcaaaggtagcataatcg

SEQ ID NO: 41926 - DNA, 20 bp, Homo sapiens
gtgcaaaggtagcataatcg

SEQ ID NO: 41927 - DNA, 22 bp, Homo sapiens
gtgcaaaggtagcataatcgct

SEQ ID NO: 41928 - DNA, 16 bp, Homo sapiens
aaaggtagcataatcg

SEQ ID NO: 41929 - DNA, 16 bp, Homo sapiens
aggtagcataatcgct

SEQ ID NO: 41930 - DNA, 16 bp, Homo sapiens
gtggcgacggagacga

SEQ ID NO: 41931 - DNA, 18 bp, Homo sapiens
gtggcgacggagacgaca

SEQ ID NO: 41932 - DNA, 19 bp, Homo sapiens
gtggcgacggagacgacaa

SEQ ID NO: 41933 - DNA, 20 bp, Homo sapiens
gtggcgacggagacgacaag

SEQ ID NO: 41934 - DNA, 21 bp, Homo sapiens
gtggcgacggagacgacaaga

SEQ ID NO: 41935 - DNA, 24 bp, Homo sapiens
gtggcgacggagacgacaagactg

SEQ ID NO: 41936 - DNA, 21 bp, Homo sapiens
tggcgacggagacgacaagac

SEQ ID NO: 41937 - DNA, 18 bp, Homo sapiens
gcgacggagacgacaaga

SEQ ID NO: 41938 - DNA, 21 bp, Homo sapiens
gcgacggagacgacaagactg

SEQ ID NO: 41939 - DNA, 26 bp, Homo sapiens
gcgacggagacgacaagactgtgctg

SEQ ID NO: 41940 - DNA, 19 bp, Homo sapiens
cgacggagacgacaagact

SEQ ID NO: 41941 - DNA, 22 bp, Homo sapiens
cgacggagacgacaagactgtg

SEQ ID NO: 41942 - DNA, 28 bp, Homo sapiens
cgacggagacgacaagactgtgctggtc

SEQ ID NO: 41943 - DNA, 21 bp, Homo sapiens
gacggagacgacaagactgtg

SEQ ID NO: 41944 - DNA, 22 bp, Homo sapiens
gacggagacgacaagactgtgc

SEQ ID NO: 41945 - DNA, 16 bp, Homo sapiens
acggagacgacaagac

SEQ ID NO: 41946 - DNA, 18 bp, Homo sapiens
acggagacgacaagactg

SEQ ID NO: 41947 - DNA, 19 bp, Homo sapiens
acggagacgacaagactgt

SEQ ID NO: 41948 - DNA, 21 bp, Homo sapiens
acggagacgacaagactgtgc

SEQ ID NO: 41949 - DNA, 22 bp, Homo sapiens
acggagacgacaagactgtgct

SEQ ID NO: 41950 - DNA, 17 bp, Homo sapiens
cggagacgacaagactg

SEQ ID NO: 41951 - DNA, 21 bp, Homo sapiens
cggagacgacaagactgtgct

SEQ ID NO: 41952 - DNA, 18 bp, Homo sapiens
agacgacaagactgtgct

SEQ ID NO: 41953 - DNA, 19 bp, Homo sapiens
gacgacaagactgtgctgg

SEQ ID NO: 41954 - DNA, 21 bp, Homo sapiens
gacgacaagactgtgctggtc

SEQ ID NO: 41955 - DNA, 22 bp, Homo sapiens
cgacaagactgtgctggtcgcg

SEQ ID NO: 41956 - DNA, 20 bp, Homo sapiens
acaagactgtgctggtcgcg

SEQ ID NO: 41957 - DNA, 16 bp, Homo sapiens
caagactgtgctggtc

SEQ ID NO: 41958 - DNA, 20 bp, Homo sapiens
taggagctcaacagatgcct

SEQ ID NO: 41959 - DNA, 22 bp, Homo sapiens
taggagctcaacagatgcctgt

SEQ ID NO: 41960 - DNA, 24 bp, Homo sapiens
taggagctcaacagatgcctgttg

SEQ ID NO: 41961 - DNA, 22 bp, Homo sapiens
aggagctcaacagatgcctgtt

SEQ ID NO: 41962 - DNA, 23 bp, Homo sapiens
aggagctcaacagatgcctgttg

SEQ ID NO: 41963 - DNA, 24 bp, Homo sapiens
tagacaattgttgatcttgggcct

SEQ ID NO: 41964 - DNA, 26 bp, Homo sapiens
tagacaattgttgatcttgggcctga

SEQ ID NO: 41965 - DNA, 23 bp, Homo sapiens
gacaattgttgatcttgggcctg

SEQ ID NO: 41966 - DNA, 24 bp, Homo sapiens
gacaattgttgatcttgggcctga

SEQ ID NO: 41967 - DNA, 25 bp, Homo sapiens
gacaattgttgatcttgggcctgat

SEQ ID NO: 41968 - DNA, 27 bp, Homo sapiens
gacaattgttgatcttgggcctgatgt

SEQ ID NO: 41969 - DNA, 22 bp, Homo sapiens
attgttgatcttgggcctgatg

SEQ ID NO: 41970 - DNA, 20 bp, Homo sapiens
ttgatcttgggcctgatgtt

SEQ ID NO: 41971 - DNA, 22 bp, Homo sapiens
tatctaaatgcagcatgccagt

SEQ ID NO: 41972 - DNA, 21 bp, Homo sapiens
atctaaatgcagcatgccagt

SEQ ID NO: 41973 - DNA, 23 bp, Homo sapiens
atctaaatgcagcatgccagtcc

SEQ ID NO: 41974 - DNA, 20 bp, Homo sapiens
tctaaatgcagcatgccagt

SEQ ID NO: 41975 - DNA, 21 bp, Homo sapiens
tctaaatgcagcatgccagtc

SEQ ID NO: 41976 - DNA, 22 bp, Homo sapiens
tctaaatgcagcatgccagtcc

SEQ ID NO: 41977 - DNA, 20 bp, Homo sapiens
ctaaatgcagcatgccagtc

SEQ ID NO: 41978 - DNA, 22 bp, Homo sapiens
ctaaatgcagcatgccagtcct

SEQ ID NO: 41979 - DNA, 23 bp, Homo sapiens
ctaaatgcagcatgccagtcctg

SEQ ID NO: 41980 - DNA, 19 bp, Homo sapiens
gcagggactggcatgctgc

SEQ ID NO: 41981 - DNA, 21 bp, Homo sapiens
gactggcatgctgcatttata

SEQ ID NO: 41982 - DNA, 22 bp, Homo sapiens
gactggcatgctgcatttatat

SEQ ID NO: 41983 - DNA, 20 bp, Homo sapiens
actggcatgctgcatttata

SEQ ID NO: 41984 - DNA, 21 bp, Homo sapiens
actggcatgctgcatttatat

SEQ ID NO: 41985 - DNA, 21 bp, Homo sapiens
ctggcatgctgcatttatata

SEQ ID NO: 41986 - DNA, 22 bp, Homo sapiens
ctggcatgctgcatttatatat

SEQ ID NO: 41987 - DNA, 24 bp, Homo sapiens
agcttttgggaattcaggtagttc

SEQ ID NO: 41988 - DNA, 25 bp, Homo sapiens
gagcttttgggaattcaggtagttc

SEQ ID NO: 41989 - DNA, 23 bp, Homo sapiens
gagcttttgggaattcaggtagt

SEQ ID NO: 41990 - DNA, 25 bp, Homo sapiens
aagagcttttgggaattcaggtagt

SEQ ID NO: 41991 - DNA, 21 bp, Homo sapiens
agcttttgggaattcaggtag

SEQ ID NO: 41992 - DNA, 22 bp, Homo sapiens
gagcttttgggaattcaggtag

SEQ ID NO: 41993 - DNA, 23 bp, Homo sapiens
agagcttttgggaattcaggtag

SEQ ID NO: 41994 - DNA, 20 bp, Homo sapiens
agcttttgggaattcaggta

SEQ ID NO: 41995 - DNA, 20 bp, Homo sapiens
gagcttttgggaattcaggt

SEQ ID NO: 41996 - DNA, 19 bp, Homo sapiens
gagcttttgggaattcagg

SEQ ID NO: 41997 - DNA, 24 bp, Homo sapiens
acctgaattaccaaaagctttatg

SEQ ID NO: 41998 - DNA, 23 bp, Homo sapiens
acctgaattaccaaaagctttat

SEQ ID NO: 41999 - DNA, 22 bp, Homo sapiens
acctgaattaccaaaagcttta

SEQ ID NO: 42000 - DNA, 20 bp, Homo sapiens
acctgaattaccaaaagctt

SEQ ID NO: 42001 - DNA, 19 bp, Homo sapiens
acctgaattaccaaaagct

SEQ ID NO: 42002 - DNA, 16 bp, Homo sapiens
cctggagagcttggtc

SEQ ID NO: 42003 - DNA, 18 bp, Homo sapiens
cctggagagcttggtctg

SEQ ID NO: 42004 - DNA, 21 bp, Homo sapiens
cctggagagcttggtctgtag

SEQ ID NO: 42005 - DNA, 23 bp, Homo sapiens
cctggagagcttggtctgtagcg

SEQ ID NO: 42006 - DNA, 22 bp, Homo sapiens
ctggagagcttggtctgtagcg

SEQ ID NO: 42007 - DNA, 20 bp, Homo sapiens
gagagcttggtctgtagcgg

SEQ ID NO: 42008 - DNA, 25 bp, Homo sapiens
agagcttggtctgtagcggtttcct

SEQ ID NO: 42009 - DNA, 21 bp, Homo sapiens
gagcttggtctgtagcggttt

SEQ ID NO: 42010 - DNA, 22 bp, Homo sapiens
gagcttggtctgtagcggtttc

SEQ ID NO: 42011 - DNA, 21 bp, Homo sapiens
agcttggtctgtagcggtttc

SEQ ID NO: 42012 - DNA, 23 bp, Homo sapiens
agcttggtctgtagcggtttcct

SEQ ID NO: 42013 - DNA, 18 bp, Homo sapiens
gcttggtctgtagcggtt

SEQ ID NO: 42014 - DNA, 19 bp, Homo sapiens
cttggtctgtagcggtttc

SEQ ID NO: 42015 - DNA, 21 bp, Homo sapiens
cttggtctgtagcggtttcct

SEQ ID NO: 42016 - DNA, 21 bp, Homo sapiens
tggtctgtagcggtttccttc

SEQ ID NO: 42017 - DNA, 23 bp, Homo sapiens
tggaaagactttgccactcttta

SEQ ID NO: 42018 - DNA, 25 bp, Homo sapiens
tatggaaagactttgccactcttta

SEQ ID NO: 42019 - DNA, 22 bp, Homo sapiens
tggaaagactttgccactcttt

SEQ ID NO: 42020 - DNA, 24 bp, Homo sapiens
tatggaaagactttgccactcttt

SEQ ID NO: 42021 - DNA, 25 bp, Homo sapiens
atatggaaagactttgccactcttt

SEQ ID NO: 42022 - DNA, 24 bp, Homo sapiens
cacatatggaaagactttgccact

SEQ ID NO: 42023 - DNA, 22 bp, Homo sapiens
cacatatggaaagactttgcca

SEQ ID NO: 42024 - DNA, 22 bp, Homo sapiens
tggcaaagtctttccatatgtg

SEQ ID NO: 42025 - DNA, 23 bp, Homo sapiens
tggcaaagtctttccatatgtgt

SEQ ID NO: 42026 - DNA, 21 bp, Homo sapiens
cacatatggaaagactttgcc

SEQ ID NO: 42027 - DNA, 19 bp, Homo sapiens
cacatatggaaagactttg

SEQ ID NO: 42028 - DNA, 20 bp, Homo sapiens
aagtctttccatatgtgtaa

SEQ ID NO: 42029 - DNA, 20 bp, Homo sapiens
tacatatggaaagactttgc

SEQ ID NO: 42030 - DNA, 21 bp, Homo sapiens
tacatatggaaagactttgcc

SEQ ID NO: 42031 - DNA, 22 bp, Homo sapiens
tacatatggaaagactttgcca

SEQ ID NO: 42032 - DNA, 24 bp, Homo sapiens
tacatatggaaagactttgccact

SEQ ID NO: 42033 - DNA, 22 bp, Homo sapiens
tggaaagactttgccactcttg

SEQ ID NO: 42034 - DNA, 23 bp, Homo sapiens
tggaaagactttgccactcttga

SEQ ID NO: 42035 - DNA, 22 bp, Homo sapiens
ggaaagactttgccactcttga

SEQ ID NO: 42036 - DNA, 22 bp, Homo sapiens
ggatccgagtcacggcaccaaa

SEQ ID NO: 42037 - DNA, 23 bp, Homo sapiens
cggatccgagtcacggcaccaaa

SEQ ID NO: 42038 - DNA, 21 bp, Homo sapiens
ggatccgagtcacggcaccaa

SEQ ID NO: 42039 - DNA, 22 bp, Homo sapiens
cggatccgagtcacggcaccaa

SEQ ID NO: 42040 - DNA, 23 bp, Homo sapiens
ccggatccgagtcacggcaccaa

SEQ ID NO: 42041 - DNA, 21 bp, Homo sapiens
cggatccgagtcacggcacca

SEQ ID NO: 42042 - DNA, 22 bp, Homo sapiens
ccggatccgagtcacggcacca

SEQ ID NO: 42043 - DNA, 23 bp, Homo sapiens
cccggatccgagtcacggcacca

SEQ ID NO: 42044 - DNA, 24 bp, Homo sapiens
ccccggatccgagtcacggcacca

SEQ ID NO: 42045 - DNA, 25 bp, Homo sapiens
tccccggatccgagtcacggcacca

SEQ ID NO: 42046 - DNA, 19 bp, Homo sapiens
ggatccgagtcacggcacc

SEQ ID NO: 42047 - DNA, 20 bp, Homo sapiens
cggatccgagtcacggcacc

SEQ ID NO: 42048 - DNA, 21 bp, Homo sapiens
ccggatccgagtcacggcacc

SEQ ID NO: 42049 - DNA, 18 bp, Homo sapiens
ggatccgagtcacggcac

SEQ ID NO: 42050 - DNA, 19 bp, Homo sapiens
cggatccgagtcacggcac

SEQ ID NO: 42051 - DNA, 16 bp, Homo sapiens
ggatccgagtcacggc

SEQ ID NO: 42052 - DNA, 17 bp, Homo sapiens
ccggatccgagtcacgg

SEQ ID NO: 42053 - DNA, 16 bp, Homo sapiens
ccggatccgagtcacg

SEQ ID NO: 42054 - DNA, 22 bp, Homo sapiens
cttcttgtgctctaggattgta

SEQ ID NO: 42055 - DNA, 23 bp, Homo sapiens
ttcttgtgctctaggattgtatt

SEQ ID NO: 42056 - DNA, 20 bp, Homo sapiens
tgctctaggattgtattttg

SEQ ID NO: 42057 - DNA, 19 bp, Homo sapiens
cgtctggttgatccagtcc

SEQ ID NO: 42058 - DNA, 20 bp, Homo sapiens
cgtctggttgatccagtcca

SEQ ID NO: 42059 - DNA, 22 bp, Homo sapiens
tgcaaaagtgatcgtggttttt

SEQ ID NO: 42060 - DNA, 23 bp, Homo sapiens
tgcaaaagtgatcgtggtttttg

SEQ ID NO: 42061 - DNA, 20 bp, Homo sapiens
caaaagtgatcgtggttttt

SEQ ID NO: 42062 - DNA, 22 bp, Homo sapiens
caaaagtgatcgtggtttttgc

SEQ ID NO: 42063 - DNA, 23 bp, Homo sapiens
caaaagtgatcgtggtttttgca

SEQ ID NO: 42064 - DNA, 20 bp, Homo sapiens
aaaagtgatcgtggtttttg

SEQ ID NO: 42065 - DNA, 21 bp, Homo sapiens
aaaagtgatcgtggtttttgc

SEQ ID NO: 42066 - DNA, 22 bp, Homo sapiens
aaaagtgatcgtggtttttgca

SEQ ID NO: 42067 - DNA, 21 bp, Homo sapiens
gtctgactcagtgactcatgt

SEQ ID NO: 42068 - DNA, 22 bp, Homo sapiens
ctcagtgactcatgtgctggca

SEQ ID NO: 42069 - DNA, 22 bp, Homo sapiens
tcagtgactcatgtgctggcag

SEQ ID NO: 42070 - DNA, 21 bp, Homo sapiens
cagtgactcatgtgctggcag

SEQ ID NO: 42071 - DNA, 20 bp, Homo sapiens
ttttcaactctaatgggaga

SEQ ID NO: 42072 - DNA, 21 bp, Homo sapiens
ttttcaactctaatgggagag

SEQ ID NO: 42073 - DNA, 21 bp, Homo sapiens
tttcaactctaatgggagaga

SEQ ID NO: 42074 - DNA, 22 bp, Homo sapiens
tttcaactctaatgggagagac

SEQ ID NO: 42075 - DNA, 23 bp, Homo sapiens
tttcaactctaatgggagagaca

SEQ ID NO: 42076 - DNA, 25 bp, Homo sapiens
tttcaactctaatgggagagacagc

SEQ ID NO: 42077 - DNA, 17 bp, Homo sapiens
agggttgatataaaatg

SEQ ID NO: 42078 - DNA, 18 bp, Homo sapiens
gagggttgatataaaatg

SEQ ID NO: 42079 - DNA, 25 bp, Homo sapiens
agggcataggagagggttgatataa

SEQ ID NO: 42080 - DNA, 24 bp, Homo sapiens
agggcataggagagggttgatata

SEQ ID NO: 42081 - DNA, 25 bp, Homo sapiens
gagggcataggagagggttgatata

SEQ ID NO: 42082 - DNA, 19 bp, Homo sapiens
cataggagagggttgatat

SEQ ID NO: 42083 - DNA, 21 bp, Homo sapiens
ggcataggagagggttgatat

SEQ ID NO: 42084 - DNA, 24 bp, Homo sapiens
gagggcataggagagggttgatat

SEQ ID NO: 42085 - DNA, 22 bp, Homo sapiens
gagggcataggagagggttgat

SEQ ID NO: 42086 - DNA, 17 bp, Homo sapiens
agggcataggagagggt

SEQ ID NO: 42087 - DNA, 19 bp, Homo sapiens
agggtgtgtgtgtttttcc

SEQ ID NO: 42088 - DNA, 24 bp, Homo sapiens
ctgactgttgccgtcctccagccc

SEQ ID NO: 42089 - DNA, 25 bp, Homo sapiens
cctgactgttgccgtcctccagccc

SEQ ID NO: 42090 - DNA, 23 bp, Homo sapiens
ctgactgttgccgtcctccagcc

SEQ ID NO: 42091 - DNA, 24 bp, Homo sapiens
cctgactgttgccgtcctccagcc

SEQ ID NO: 42092 - DNA, 22 bp, Homo sapiens
ctgactgttgccgtcctccagc

SEQ ID NO: 42093 - DNA, 23 bp, Homo sapiens
cctgactgttgccgtcctccagc

SEQ ID NO: 42094 - DNA, 22 bp, Homo sapiens
cctgactgttgccgtcctccag

SEQ ID NO: 42095 - DNA, 21 bp, Homo sapiens
cctgactgttgccgtcctcca

SEQ ID NO: 42096 - DNA, 19 bp, Homo sapiens
ctgactgttgccgtcctcc

SEQ ID NO: 42097 - DNA, 20 bp, Homo sapiens
cctgactgttgccgtcctcc

SEQ ID NO: 42098 - DNA, 19 bp, Homo sapiens
cctgactgttgccgtcctc

SEQ ID NO: 42099 - DNA, 23 bp, Homo sapiens
ttgtgcttgatctaaccatgtgg

SEQ ID NO: 42100 - DNA, 25 bp, Homo sapiens
ttgtgcttgatctaaccatgtggtt

SEQ ID NO: 42101 - DNA, 26 bp, Homo sapiens
ttgtgcttgatctaaccatgtggttg

SEQ ID NO: 42102 - DNA, 27 bp, Homo sapiens
ttgtgcttgatctaaccatgtggttgc

SEQ ID NO: 42103 - DNA, 21 bp, Homo sapiens
tgtgcttgatctaaccatgtg

SEQ ID NO: 42104 - DNA, 24 bp, Homo sapiens
tgtgcttgatctaaccatgtggtt

SEQ ID NO: 42105 - DNA, 20 bp, Homo sapiens
aaaacatggttccgtcaagc

SEQ ID NO: 42106 - DNA, 22 bp, Homo sapiens
aaaacatggttccgtcaagcac

SEQ ID NO: 42107 - DNA, 23 bp, Homo sapiens
aaaacatggttccgtcaagcacc

SEQ ID NO: 42108 - DNA, 26 bp, Homo sapiens
aaaacatggttccgtcaagcaccatg

SEQ ID NO: 42109 - DNA, 17 bp, Homo sapiens
aaacatggttccgtcaa

SEQ ID NO: 42110 - DNA, 18 bp, Homo sapiens
aaacatggttccgtcaag

SEQ ID NO: 42111 - DNA, 19 bp, Homo sapiens
aaacatggttccgtcaagc

SEQ ID NO: 42112 - DNA, 20 bp, Homo sapiens
aaacatggttccgtcaagca

SEQ ID NO: 42113 - DNA, 21 bp, Homo sapiens
aaacatggttccgtcaagcac

SEQ ID NO: 42114 - DNA, 22 bp, Homo sapiens
aaacatggttccgtcaagcacc

SEQ ID NO: 42115 - DNA, 23 bp, Homo sapiens
aaacatggttccgtcaagcacca

SEQ ID NO: 42116 - DNA, 24 bp, Homo sapiens
aaacatggttccgtcaagcaccat

SEQ ID NO: 42117 - DNA, 25 bp, Homo sapiens
aaacatggttccgtcaagcaccatg

SEQ ID NO: 42118 - DNA, 19 bp, Homo sapiens
aacatggttccgtcaagca

SEQ ID NO: 42119 - DNA, 22 bp, Homo sapiens
aacatggttccgtcaagcacca

SEQ ID NO: 42120 - DNA, 23 bp, Homo sapiens
atctggtgtatagcgttgctcaa

SEQ ID NO: 42121 - DNA, 22 bp, Homo sapiens
atctggtgtatagcgttgctca

SEQ ID NO: 42122 - DNA, 21 bp, Homo sapiens
atctggtgtatagcgttgctc

SEQ ID NO: 42123 - DNA, 20 bp, Homo sapiens
atctggtgtatagcgttgct

SEQ ID NO: 42124 - DNA, 18 bp, Homo sapiens
atctggtgtatagcgttg

SEQ ID NO: 42125 - DNA, 17 bp, Homo sapiens
ggtctatctggtgtata

SEQ ID NO: 42126 - DNA, 17 bp, Homo sapiens
cgtctgtccacctacct

SEQ ID NO: 42127 - DNA, 19 bp, Homo sapiens
tccgtctgtccacctacct

SEQ ID NO: 42128 - DNA, 20 bp, Homo sapiens
gtccgtctgtccacctacct

SEQ ID NO: 42129 - DNA, 24 bp, Homo sapiens
catccgtccgtctgtccacctacc

SEQ ID NO: 42130 - DNA, 23 bp, Homo sapiens
catccgtccgtctgtccacctac

SEQ ID NO: 42131 - DNA, 22 bp, Homo sapiens
catccgtccgtctgtccaccta

SEQ ID NO: 42132 - DNA, 21 bp, Homo sapiens
catccgtccgtctgtccacct

SEQ ID NO: 42133 - DNA, 20 bp, Homo sapiens
catccgtccgtctgtccacc

SEQ ID NO: 42134 - DNA, 18 bp, Homo sapiens
tctgtccatccgtccgtc

SEQ ID NO: 42135 - DNA, 25 bp, Homo sapiens
tggaccgaggaaggaaggaaggcaa

SEQ ID NO: 42136 - DNA, 22 bp, Homo sapiens
gaccgaggaaggaaggaaggca

SEQ ID NO: 42137 - DNA, 25 bp, Homo sapiens
agtggaccgaggaaggaaggaaggc

SEQ ID NO: 42138 - DNA, 26 bp, Homo sapiens
ggagtggaccgaggaaggaaggaagg

SEQ ID NO: 42139 - DNA, 18 bp, Homo sapiens
accgaggaaggaaggaag

SEQ ID NO: 42140 - DNA, 22 bp, Homo sapiens
agtggaccgaggaaggaaggaa

SEQ ID NO: 42141 - DNA, 19 bp, Homo sapiens
tggaccgaggaaggaagga

SEQ ID NO: 42142 - DNA, 20 bp, Homo sapiens
agtggaccgaggaaggaagg

SEQ ID NO: 42143 - DNA, 19 bp, Homo sapiens
agtggaccgaggaaggaag

SEQ ID NO: 42144 - DNA, 17 bp, Homo sapiens
gaaaggagtggaccgag

SEQ ID NO: 42145 - DNA, 16 bp, Homo sapiens
gaaaggagtggaccga

SEQ ID NO: 42146 - DNA, 27 bp, Homo sapiens
tgaagtgatgtgtaactgatcaggatc

SEQ ID NO: 42147 - DNA, 28 bp, Homo sapiens
ctgaagtgatgtgtaactgatcaggatc

SEQ ID NO: 42148 - DNA, 26 bp, Homo sapiens
ctgaagtgatgtgtaactgatcagga

SEQ ID NO: 42149 - DNA, 24 bp, Homo sapiens
tgaagtgatgtgtaactgatcagg

SEQ ID NO: 42150 - DNA, 25 bp, Homo sapiens
ctgaagtgatgtgtaactgatcagg

SEQ ID NO: 42151 - DNA, 21 bp, Homo sapiens
aagtgatgtgtaactgatcag

SEQ ID NO: 42152 - DNA, 16 bp, Homo sapiens
gatgtgtaactgatca

SEQ ID NO: 42153 - DNA, 23 bp, Homo sapiens
ctgaagtgatgtgtaactgatca

SEQ ID NO: 42154 - DNA, 21 bp, Homo sapiens
tgaagtgatgtgtaactgatc

SEQ ID NO: 42155 - DNA, 22 bp, Homo sapiens
ctgaagtgatgtgtaactgatc

SEQ ID NO: 42156 - DNA, 21 bp, Homo sapiens
ctgaagtgatgtgtaactgat

SEQ ID NO: 42157 - DNA, 21 bp, Homo sapiens
ccctgaagtgatgtgtaactg

SEQ ID NO: 42158 - DNA, 22 bp, Homo sapiens
ttgtccaattaccacttctttt

SEQ ID NO: 42159 - DNA, 18 bp, Homo sapiens
gttggccatctgagtgag

SEQ ID NO: 42160 - DNA, 17 bp, Homo sapiens
ggcgtgtgagtgtgtgt

SEQ ID NO: 42161 - DNA, 27 bp, Homo sapiens
gtgagtgtgtgtgtgtgagtgtgtgtc

SEQ ID NO: 42162 - DNA, 28 bp, Homo sapiens
gtgagtgtgtgtgtgtgagtgtgtgtcg

SEQ ID NO: 42163 - DNA, 22 bp, Homo sapiens
tgagtgtgtgtgtgtgagtgtg

SEQ ID NO: 42164 - DNA, 25 bp, Homo sapiens
tgagtgtgtgtgtgtgagtgtgtgt

SEQ ID NO: 42165 - DNA, 26 bp, Homo sapiens
tgagtgtgtgtgtgtgagtgtgtgtc

SEQ ID NO: 42166 - DNA, 27 bp, Homo sapiens
tgagtgtgtgtgtgtgagtgtgtgtcg

SEQ ID NO: 42167 - DNA, 28 bp, Homo sapiens
tgagtgtgtgtgtgtgagtgtgtgtcgc

SEQ ID NO: 42168 - DNA, 25 bp, Homo sapiens
gagtgtgtgtgtgtgagtgtgtgtc

SEQ ID NO: 42169 - DNA, 26 bp, Homo sapiens
gagtgtgtgtgtgtgagtgtgtgtcg

SEQ ID NO: 42170 - DNA, 25 bp, Homo sapiens
tgtgtgtgtgtgagtgtgtgtcgct

SEQ ID NO: 42171 - DNA, 18 bp, Homo sapiens
cacgctcatgcacacacc

SEQ ID NO: 42172 - DNA, 19 bp, Homo sapiens
cacgctcatgcacacaccc

SEQ ID NO: 42173 - DNA, 20 bp, Homo sapiens
cacgctcatgcacacaccca

SEQ ID NO: 42174 - DNA, 21 bp, Homo sapiens
cacgctcatgcacacacccac

SEQ ID NO: 42175 - DNA, 23 bp, Homo sapiens
cacgctcatgcacacacccacac

SEQ ID NO: 42176 - DNA, 24 bp, Homo sapiens
cacgctcatgcacacacccacacg

SEQ ID NO: 42177 - DNA, 25 bp, Homo sapiens
cacgctcatgcacacacccacacgc

SEQ ID NO: 42178 - DNA, 16 bp, Homo sapiens
atctgcatacccatag

SEQ ID NO: 42179 - DNA, 24 bp, Homo sapiens
atggatggaaaccttcaagcaggc

SEQ ID NO: 42180 - DNA, 26 bp, Homo sapiens
tacatggatggaaaccttcaagcagg

SEQ ID NO: 42181 - DNA, 22 bp, Homo sapiens
atggatggaaaccttcaagcag

SEQ ID NO: 42182 - DNA, 23 bp, Homo sapiens
catggatggaaaccttcaagcag

SEQ ID NO: 42183 - DNA, 21 bp, Homo sapiens
atggatggaaaccttcaagca

SEQ ID NO: 42184 - DNA, 22 bp, Homo sapiens
catggatggaaaccttcaagca

SEQ ID NO: 42185 - DNA, 23 bp, Homo sapiens
acatggatggaaaccttcaagca

SEQ ID NO: 42186 - DNA, 24 bp, Homo sapiens
tacatggatggaaaccttcaagca

SEQ ID NO: 42187 - DNA, 21 bp, Homo sapiens
catggatggaaaccttcaagc

SEQ ID NO: 42188 - DNA, 22 bp, Homo sapiens
acatggatggaaaccttcaagc

SEQ ID NO: 42189 - DNA, 21 bp, Homo sapiens
acatggatggaaaccttcaag

SEQ ID NO: 42190 - DNA, 22 bp, Homo sapiens
tacatggatggaaaccttcaag

SEQ ID NO: 42191 - DNA, 21 bp, Homo sapiens
tacatggatggaaaccttcaa

SEQ ID NO: 42192 - DNA, 20 bp, Homo sapiens
tacatggatggaaaccttca

SEQ ID NO: 42193 - DNA, 19 bp, Homo sapiens
tacatggatggaaaccttc

SEQ ID NO: 42194 - DNA, 26 bp, Homo sapiens
atggaggttctagaccatgttagtgt

SEQ ID NO: 42195 - DNA, 23 bp, Homo sapiens
atggaggttctagaccatgttag

SEQ ID NO: 42196 - DNA, 24 bp, Homo sapiens
tatggaggttctagaccatgttag

SEQ ID NO: 42197 - DNA, 22 bp, Homo sapiens
atggaggttctagaccatgtta

SEQ ID NO: 42198 - DNA, 23 bp, Homo sapiens
tatggaggttctagaccatgtta

SEQ ID NO: 42199 - DNA, 21 bp, Homo sapiens
atggaggttctagaccatgtt

SEQ ID NO: 42200 - DNA, 20 bp, Homo sapiens
atggaggttctagaccatgt

SEQ ID NO: 42201 - DNA, 21 bp, Homo sapiens
tatggaggttctagaccatgt

SEQ ID NO: 42202 - DNA, 20 bp, Homo sapiens
tatggaggttctagaccatg

SEQ ID NO: 42203 - DNA, 17 bp, Homo sapiens
ggcttgtatggaggttc

SEQ ID NO: 42204 - DNA, 16 bp, Homo sapiens
ggtgcccgtcccgggg

SEQ ID NO: 42205 - DNA, 17 bp, Homo sapiens
ggtgcccgtcccggggc

SEQ ID NO: 42206 - DNA, 18 bp, Homo sapiens
ggtgcccgtcccggggct

SEQ ID NO: 42207 - DNA, 20 bp, Homo sapiens
ggtgcccgtcccggggctgc

SEQ ID NO: 42208 - DNA, 21 bp, Homo sapiens
ggtgcccgtcccggggctgcg

SEQ ID NO: 42209 - DNA, 23 bp, Homo sapiens
ggtgcccgtcccggggctgcgcg

SEQ ID NO: 42210 - DNA, 24 bp, Homo sapiens
ggtgcccgtcccggggctgcgcga

SEQ ID NO: 42211 - DNA, 25 bp, Homo sapiens
ggtgcccgtcccggggctgcgcgag

SEQ ID NO: 42212 - DNA, 22 bp, Homo sapiens
gtgcccgtcccggggctgcgcg

SEQ ID NO: 42213 - DNA, 25 bp, Homo sapiens
tgcccgtcccggggctgcgcgaggc

SEQ ID NO: 42214 - DNA, 26 bp, Homo sapiens
tgcccgtcccggggctgcgcgaggca

SEQ ID NO: 42215 - DNA, 28 bp, Homo sapiens
gcccgtcccggggctgcgcgaggcacag

SEQ ID NO: 42216 - DNA, 18 bp, Homo sapiens
cgtcccggggctgcgcga

SEQ ID NO: 42217 - DNA, 27 bp, Homo sapiens
cgtcccggggctgcgcgaggcacaggc

SEQ ID NO: 42218 - DNA, 23 bp, Homo sapiens
gtcccggggctgcgcgaggcaca

SEQ ID NO: 42219 - DNA, 26 bp, Homo sapiens
gtcccggggctgcgcgaggcacaggc

SEQ ID NO: 42220 - DNA, 18 bp, Homo sapiens
tcccggggctgcgcgagg

SEQ ID NO: 42221 - DNA, 20 bp, Homo sapiens
tcccggggctgcgcgaggca

SEQ ID NO: 42222 - DNA, 21 bp, Homo sapiens
tcccggggctgcgcgaggcac

SEQ ID NO: 42223 - DNA, 22 bp, Homo sapiens
tcccggggctgcgcgaggcaca

SEQ ID NO: 42224 - DNA, 23 bp, Homo sapiens
tcccggggctgcgcgaggcacag

SEQ ID NO: 42225 - DNA, 24 bp, Homo sapiens
tcccggggctgcgcgaggcacagg

SEQ ID NO: 42226 - DNA, 25 bp, Homo sapiens
tcccggggctgcgcgaggcacaggc

SEQ ID NO: 42227 - DNA, 22 bp, Homo sapiens
cccggggctgcgcgaggcacag

SEQ ID NO: 42228 - DNA, 24 bp, Homo sapiens
cccggggctgcgcgaggcacaggc

SEQ ID NO: 42229 - DNA, 25 bp, Homo sapiens
cccggggctgcgcgaggcacaggcg

SEQ ID NO: 42230 - DNA, 18 bp, Homo sapiens
ccggggctgcgcgaggca

SEQ ID NO: 42231 - DNA, 19 bp, Homo sapiens
ccggggctgcgcgaggcac

SEQ ID NO: 42232 - DNA, 22 bp, Homo sapiens
ccggggctgcgcgaggcacagg

SEQ ID NO: 42233 - DNA, 23 bp, Homo sapiens
ccggggctgcgcgaggcacaggc

SEQ ID NO: 42234 - DNA, 17 bp, Homo sapiens
cggggctgcgcgaggca

SEQ ID NO: 42235 - DNA, 21 bp, Homo sapiens
cggggctgcgcgaggcacagg

SEQ ID NO: 42236 - DNA, 22 bp, Homo sapiens
cggggctgcgcgaggcacaggc

SEQ ID NO: 42237 - DNA, 21 bp, Homo sapiens
ggggctgcgcgaggcacaggc

SEQ ID NO: 42238 - DNA, 17 bp, Homo sapiens
gggctgcgcgaggcaca

SEQ ID NO: 42239 - DNA, 20 bp, Homo sapiens
gggctgcgcgaggcacaggc

SEQ ID NO: 42240 - DNA, 19 bp, Homo sapiens
ggctgcgcgaggcacaggc

SEQ ID NO: 42241 - DNA, 17 bp, Homo sapiens
ctgcgcgaggcacaggc

SEQ ID NO: 42242 - DNA, 16 bp, Homo sapiens
tgcgcgaggcacaggc

SEQ ID NO: 42243 - DNA, 24 bp, Homo sapiens
actggacttggagtcagaaacagg

SEQ ID NO: 42244 - DNA, 22 bp, Homo sapiens
ctggacttggagtcagaaacag

SEQ ID NO: 42245 - DNA, 23 bp, Homo sapiens
actggacttggagtcagaaacag

SEQ ID NO: 42246 - DNA, 21 bp, Homo sapiens
ctggacttggagtcagaaaca

SEQ ID NO: 42247 - DNA, 22 bp, Homo sapiens
actggacttggagtcagaaaca

SEQ ID NO: 42248 - DNA, 21 bp, Homo sapiens
actggacttggagtcagaaac

SEQ ID NO: 42249 - DNA, 22 bp, Homo sapiens
aaaggtaattgtggtttctgct

SEQ ID NO: 42250 - DNA, 17 bp, Homo sapiens
gtggtttctgcttttaa

SEQ ID NO: 42251 - DNA, 18 bp, Homo sapiens
cctggactgagccgtgct

SEQ ID NO: 42252 - DNA, 22 bp, Homo sapiens
cctggactgagccgtgctactg

SEQ ID NO: 42253 - DNA, 17 bp, Homo sapiens
ctggactgagccgtgct

SEQ ID NO: 42254 - DNA, 19 bp, Homo sapiens
ctggactgagccgtgctac

SEQ ID NO: 42255 - DNA, 20 bp, Homo sapiens
ctggactgagccgtgctact

SEQ ID NO: 42256 - DNA, 21 bp, Homo sapiens
ctggactgagccgtgctactg

SEQ ID NO: 42257 - DNA, 23 bp, Homo sapiens
ctggactgagccgtgctactggc

SEQ ID NO: 42258 - DNA, 24 bp, Homo sapiens
ctggactgagccgtgctactggct

SEQ ID NO: 42259 - DNA, 26 bp, Homo sapiens
ctggactgagccgtgctactggcttc

SEQ ID NO: 42260 - DNA, 21 bp, Homo sapiens
ttcggtatactttgtgaattg

SEQ ID NO: 42261 - DNA, 21 bp, Homo sapiens
tcggtatactttgtgaattgg

SEQ ID NO: 42262 - DNA, 22 bp, Homo sapiens
tcggtatactttgtgaattggc

SEQ ID NO: 42263 - DNA, 23 bp, Homo sapiens
tcggtatactttgtgaattggct

SEQ ID NO: 42264 - DNA, 22 bp, Homo sapiens
accaactcacgaagtataccga

SEQ ID NO: 42265 - DNA, 21 bp, Homo sapiens
aactcacgaagtataccgaag

SEQ ID NO: 42266 - DNA, 17 bp, Homo sapiens
agcagtccctccccctg

SEQ ID NO: 42267 - DNA, 21 bp, Homo sapiens
tggggatttggagaagtggtg

SEQ ID NO: 42268 - DNA, 22 bp, Homo sapiens
tggtgcaaaagtgattgcagtg

SEQ ID NO: 42269 - DNA, 21 bp, Homo sapiens
caaaagtgattgcagtgtttg

SEQ ID NO: 42270 - DNA, 18 bp, Homo sapiens
aaaagtgattgcagtgtt

SEQ ID NO: 42271 - DNA, 19 bp, Homo sapiens
aaaagtgattgcagtgttt

SEQ ID NO: 42272 - DNA, 21 bp, Homo sapiens
aaaagtgattgcagtgtttgc

SEQ ID NO: 42273 - DNA, 22 bp, Homo sapiens
aaaagtgattgcagtgtttgcc

SEQ ID NO: 42274 - DNA, 23 bp, Homo sapiens
aaaagtgattgcagtgtttgcca

SEQ ID NO: 42275 - DNA, 26 bp, Homo sapiens
aaaagtgattgcagtgtttgccaata

SEQ ID NO: 42276 - DNA, 20 bp, Homo sapiens
aaagtgattgcagtgtttgc

SEQ ID NO: 42277 - DNA, 21 bp, Homo sapiens
aaagtgattgcagtgtttgcc

SEQ ID NO: 42278 - DNA, 22 bp, Homo sapiens
aaagtgattgcagtgtttgcca

SEQ ID NO: 42279 - DNA, 18 bp, Homo sapiens
agttacttttgcaccagc

SEQ ID NO: 42280 - DNA, 27 bp, Homo sapiens
ttcaacgggtatttattgagcacccac

SEQ ID NO: 42281 - DNA, 24 bp, Homo sapiens
ttcaacgggtatttattgagcacc

SEQ ID NO: 42282 - DNA, 22 bp, Homo sapiens
tcaacgggtatttattgagcac

SEQ ID NO: 42283 - DNA, 23 bp, Homo sapiens
ttcaacgggtatttattgagcac

SEQ ID NO: 42284 - DNA, 21 bp, Homo sapiens
tcaacgggtatttattgagca

SEQ ID NO: 42285 - DNA, 21 bp, Homo sapiens
ttcaacgggtatttattgagc

SEQ ID NO: 42286 - DNA, 20 bp, Homo sapiens
ttcaacgggtatttattgag

SEQ ID NO: 42287 - DNA, 17 bp, Homo sapiens
ttcaacgggtatttatt

SEQ ID NO: 42288 - DNA, 23 bp, Homo sapiens
tcaataaatgtctgttgaattga

SEQ ID NO: 42289 - DNA, 22 bp, Homo sapiens
ctcaataaatgtctgttgaatt

SEQ ID NO: 42290 - DNA, 28 bp, Homo sapiens
aatgagccagttggacaggagcagtgcc

SEQ ID NO: 42291 - DNA, 23 bp, Homo sapiens
aatgagccagttggacaggagca

SEQ ID NO: 42292 - DNA, 23 bp, Homo sapiens
ttttgctggtagagctgaggaca

SEQ ID NO: 42293 - DNA, 21 bp, Homo sapiens
gctggtagagctgaggacagc

SEQ ID NO: 42294 - DNA, 17 bp, Homo sapiens
ctggtagagctgaggac

SEQ ID NO: 42295 - DNA, 20 bp, Homo sapiens
ctggtagagctgaggacagc

SEQ ID NO: 42296 - DNA, 18 bp, Homo sapiens
ggtagagctgaggacagc

SEQ ID NO: 42297 - DNA, 17 bp, Homo sapiens
tgttagacctagtacac

SEQ ID NO: 42298 - DNA, 19 bp, Homo sapiens
tgttagacctagtacacgt

SEQ ID NO: 42299 - DNA, 20 bp, Homo sapiens
tgttagacctagtacacgtc

SEQ ID NO: 42300 - DNA, 21 bp, Homo sapiens
tgttagacctagtacacgtcc

SEQ ID NO: 42301 - DNA, 22 bp, Homo sapiens
tgttagacctagtacacgtcct

SEQ ID NO: 42302 - DNA, 18 bp, Homo sapiens
ttagacctagtacacgtc

SEQ ID NO: 42303 - DNA, 20 bp, Homo sapiens
ttagacctagtacacgtcct

SEQ ID NO: 42304 - DNA, 22 bp, Homo sapiens
ttagacctagtacacgtccttt

SEQ ID NO: 42305 - DNA, 23 bp, Homo sapiens
ttagacctagtacacgtccttta

SEQ ID NO: 42306 - DNA, 27 bp, Homo sapiens
ttagacctagtacacgtcctttagatt

SEQ ID NO: 42307 - DNA, 20 bp, Homo sapiens
agacctagtacacgtccttt

SEQ ID NO: 42308 - DNA, 22 bp, Homo sapiens
agacctagtacacgtcctttag

SEQ ID NO: 42309 - DNA, 16 bp, Homo sapiens
cctagtacacgtcctt

SEQ ID NO: 42310 - DNA, 18 bp, Homo sapiens
ggctggtcagatgggagt

SEQ ID NO: 42311 - DNA, 20 bp, Homo sapiens
ggctggtcagatgggagtgg

SEQ ID NO: 42312 - DNA, 21 bp, Homo sapiens
ggctggtcagatgggagtgga

SEQ ID NO: 42313 - DNA, 23 bp, Homo sapiens
ggctggtcagatgggagtggaca

SEQ ID NO: 42314 - DNA, 22 bp, Homo sapiens
tcttgaagtcagaacccgcaaa

SEQ ID NO: 42315 - DNA, 20 bp, Homo sapiens
cttgaagtcagaacccgcaa

SEQ ID NO: 42316 - DNA, 22 bp, Homo sapiens
gtcttgaagtcagaacccgcaa

SEQ ID NO: 42317 - DNA, 20 bp, Homo sapiens
tcttgaagtcagaacccgca

SEQ ID NO: 42318 - DNA, 21 bp, Homo sapiens
gtcttgaagtcagaacccgca

SEQ ID NO: 42319 - DNA, 19 bp, Homo sapiens
tcttgaagtcagaacccgc

SEQ ID NO: 42320 - DNA, 18 bp, Homo sapiens
tcttgaagtcagaacccg

SEQ ID NO: 42321 - DNA, 20 bp, Homo sapiens
ttctggataacatgctgaag

SEQ ID NO: 42322 - DNA, 21 bp, Homo sapiens
ttctggataacatgctgaagc

SEQ ID NO: 42323 - DNA, 23 bp, Homo sapiens
ttctggataacatgctgaagctt

SEQ ID NO: 42324 - DNA, 24 bp, Homo sapiens
ttctggataacatgctgaagcttc

SEQ ID NO: 42325 - DNA, 21 bp, Homo sapiens
ggataacatgctgaagcttct

SEQ ID NO: 42326 - DNA, 19 bp, Homo sapiens
tccgcatatgcctggctag

SEQ ID NO: 42327 - DNA, 23 bp, Homo sapiens
tccgcatatgcctggctagctcc

SEQ ID NO: 42328 - DNA, 21 bp, Homo sapiens
ccgcatatgcctggctagctc

SEQ ID NO: 42329 - DNA, 22 bp, Homo sapiens
cgcatatgcctggctagctcct

SEQ ID NO: 42330 - DNA, 23 bp, Homo sapiens
aggagctagccaggcatatgcag

SEQ ID NO: 42331 - DNA, 26 bp, Homo sapiens
aggagctagccaggcatatgcagagc

SEQ ID NO: 42332 - DNA, 25 bp, Homo sapiens
ggagctagccaggcatatgcagagc

SEQ ID NO: 42333 - DNA, 21 bp, Homo sapiens
gagctagccaggcatatgcag

SEQ ID NO: 42334 - DNA, 22 bp, Homo sapiens
gagctagccaggcatatgcaga

SEQ ID NO: 42335 - DNA, 24 bp, Homo sapiens
gagctagccaggcatatgcagagc

SEQ ID NO: 42336 - DNA, 22 bp, Homo sapiens
agctagccaggcatatgcagag

SEQ ID NO: 42337 - DNA, 23 bp, Homo sapiens
agctagccaggcatatgcagagc

SEQ ID NO: 42338 - DNA, 18 bp, Homo sapiens
caggcatatgcagagcgt

SEQ ID NO: 42339 - DNA, 28 bp, Homo sapiens
atagtggttgtgaatttaccttctcctc

SEQ ID NO: 42340 - DNA, 22 bp, Homo sapiens
tagtggttgtgaatttaccttc

SEQ ID NO: 42341 - DNA, 21 bp, Homo sapiens
tagtggttgtgaatttacctt

SEQ ID NO: 42342 - DNA, 23 bp, Homo sapiens
tcacaaggtattgactggcgtat

SEQ ID NO: 42343 - DNA, 23 bp, Homo sapiens
ttcacaaggtattgactggcgta

SEQ ID NO: 42344 - DNA, 21 bp, Homo sapiens
tcacaaggtattgactggcgt

SEQ ID NO: 42345 - DNA, 22 bp, Homo sapiens
ttcacaaggtattgactggcgt

SEQ ID NO: 42346 - DNA, 20 bp, Homo sapiens
tcacaaggtattgactggcg

SEQ ID NO: 42347 - DNA, 21 bp, Homo sapiens
ttcacaaggtattgactggcg

SEQ ID NO: 42348 - DNA, 19 bp, Homo sapiens
ttcacaaggtattgactgg

SEQ ID NO: 42349 - DNA, 22 bp, Homo sapiens
tctttcttctctcccttgcagg

SEQ ID NO: 42350 - DNA, 24 bp, Homo sapiens
tgtctttcttctctcccttgcagg

SEQ ID NO: 42351 - DNA, 22 bp, Homo sapiens
tgtctttcttctctcccttgca

SEQ ID NO: 42352 - DNA, 21 bp, Homo sapiens
tgtctttcttctctcccttgc

SEQ ID NO: 42353 - DNA, 17 bp, Homo sapiens
ggctggacatccctcat

SEQ ID NO: 42354 - DNA, 23 bp, Homo sapiens
ccaaggaaggaggctggacatcc

SEQ ID NO: 42355 - DNA, 23 bp, Homo sapiens
cccaaggaaggaggctggacatc

SEQ ID NO: 42356 - DNA, 22 bp, Homo sapiens
cccaaggaaggaggctggacat

SEQ ID NO: 42357 - DNA, 21 bp, Homo sapiens
ccccaaggaaggaggctggac

SEQ ID NO: 42358 - DNA, 24 bp, Homo sapiens
taaggggtgtatggcagatgcacc

SEQ ID NO: 42359 - DNA, 23 bp, Homo sapiens
taaggggtgtatggcagatgcac

SEQ ID NO: 42360 - DNA, 21 bp, Homo sapiens
taaggggtgtatggcagatgc

SEQ ID NO: 42361 - DNA, 20 bp, Homo sapiens
taaggggtgtatggcagatg

SEQ ID NO: 42362 - DNA, 24 bp, Homo sapiens
tggagtccaggaatctgcattttt

SEQ ID NO: 42363 - DNA, 23 bp, Homo sapiens
gggtgtggagtccaggaatctgc

SEQ ID NO: 42364 - DNA, 19 bp, Homo sapiens
cttgacctgggactcggac

SEQ ID NO: 42365 - DNA, 23 bp, Homo sapiens
cttgacctgggactcggacagct

SEQ ID NO: 42366 - DNA, 24 bp, Homo sapiens
cttgacctgggactcggacagctg

SEQ ID NO: 42367 - DNA, 22 bp, Homo sapiens
ttgacctgggactcggacagct

SEQ ID NO: 42368 - DNA, 23 bp, Homo sapiens
ttgacctgggactcggacagctg

SEQ ID NO: 42369 - DNA, 16 bp, Homo sapiens
tgacctgggactcgga

SEQ ID NO: 42370 - DNA, 17 bp, Homo sapiens
tgacctgggactcggac

SEQ ID NO: 42371 - DNA, 19 bp, Homo sapiens
tgacctgggactcggacag

SEQ ID NO: 42372 - DNA, 20 bp, Homo sapiens
tgacctgggactcggacagc

SEQ ID NO: 42373 - DNA, 21 bp, Homo sapiens
tgacctgggactcggacagct

SEQ ID NO: 42374 - DNA, 23 bp, Homo sapiens
tgacctgggactcggacagctgc

SEQ ID NO: 42375 - DNA, 25 bp, Homo sapiens
tgacctgggactcggacagctgctt

SEQ ID NO: 42376 - DNA, 16 bp, Homo sapiens
gttggagattgagact

SEQ ID NO: 42377 - DNA, 17 bp, Homo sapiens
gttggagattgagacta

SEQ ID NO: 42378 - DNA, 18 bp, Homo sapiens
ggagattgagactagtag

SEQ ID NO: 42379 - DNA, 28 bp, Homo sapiens
ggagattgagactagtagggctaggcct

SEQ ID NO: 42380 - DNA, 25 bp, Homo sapiens
ctgccctggcccgagggaccgactg

SEQ ID NO: 42381 - DNA, 24 bp, Homo sapiens
ctgccctggcccgagggaccgact

SEQ ID NO: 42382 - DNA, 23 bp, Homo sapiens
ctgccctggcccgagggaccgac

SEQ ID NO: 42383 - DNA, 21 bp, Homo sapiens
tgccctggcccgagggaccga

SEQ ID NO: 42384 - DNA, 21 bp, Homo sapiens
ctgccctggcccgagggaccg

SEQ ID NO: 42385 - DNA, 20 bp, Homo sapiens
ctgccctggcccgagggacc

SEQ ID NO: 42386 - DNA, 19 bp, Homo sapiens
ctgccctggcccgagggac

SEQ ID NO: 42387 - DNA, 17 bp, Homo sapiens
ctgccctggcccgaggg

SEQ ID NO: 42388 - DNA, 25 bp, Homo sapiens
cggccccacgcaccagggtaagaga

SEQ ID NO: 42389 - DNA, 24 bp, Homo sapiens
cggccccacgcaccagggtaagag

SEQ ID NO: 42390 - DNA, 22 bp, Homo sapiens
ggccccacgcaccagggtaaga

SEQ ID NO: 42391 - DNA, 22 bp, Homo sapiens
cggccccacgcaccagggtaag

SEQ ID NO: 42392 - DNA, 21 bp, Homo sapiens
cggccccacgcaccagggtaa

SEQ ID NO: 42393 - DNA, 20 bp, Homo sapiens
cggccccacgcaccagggta

SEQ ID NO: 42394 - DNA, 19 bp, Homo sapiens
cggccccacgcaccagggt

SEQ ID NO: 42395 - DNA, 27 bp, Homo sapiens
ctgactaactcccactctacagggaac

SEQ ID NO: 42396 - DNA, 22 bp, Homo sapiens
ctaactcccactctacagggaa

SEQ ID NO: 42397 - DNA, 21 bp, Homo sapiens
ctaactcccactctacaggga

SEQ ID NO: 42398 - DNA, 20 bp, Homo sapiens
ctaactcccactctacaggg

SEQ ID NO: 42399 - DNA, 24 bp, Homo sapiens
ctgactaactcccactctacaggg

SEQ ID NO: 42400 - DNA, 19 bp, Homo sapiens
ctaactcccactctacagg

SEQ ID NO: 42401 - DNA, 20 bp, Homo sapiens
actaactcccactctacagg

SEQ ID NO: 42402 - DNA, 22 bp, Homo sapiens
tgactaactcccactctacagg

SEQ ID NO: 42403 - DNA, 18 bp, Homo sapiens
ttaaactgactaactccc

SEQ ID NO: 42404 - DNA, 17 bp, Homo sapiens
aggaggaggtctgagcc

SEQ ID NO: 42405 - DNA, 22 bp, Homo sapiens
gtgtgaggaggaggtctgagcc

SEQ ID NO: 42406 - DNA, 25 bp, Homo sapiens
taggtagagtgtgaggaggaggtct

SEQ ID NO: 42407 - DNA, 26 bp, Homo sapiens
gtaggtagagtgtgaggaggaggtct

SEQ ID NO: 42408 - DNA, 23 bp, Homo sapiens
taggtagagtgtgaggaggaggt

SEQ ID NO: 42409 - DNA, 22 bp, Homo sapiens
taggtagagtgtgaggaggagg

SEQ ID NO: 42410 - DNA, 21 bp, Homo sapiens
taggtagagtgtgaggaggag

SEQ ID NO: 42411 - DNA, 22 bp, Homo sapiens
gtaggtagagtgtgaggaggag

SEQ ID NO: 42412 - DNA, 16 bp, Homo sapiens
gaaagagcttgtcgct

SEQ ID NO: 42413 - DNA, 17 bp, Homo sapiens
gaaagagcttgtcgctg

SEQ ID NO: 42414 - DNA, 18 bp, Homo sapiens
gaaagagcttgtcgctgc

SEQ ID NO: 42415 - DNA, 19 bp, Homo sapiens
gaaagagcttgtcgctgcg

SEQ ID NO: 42416 - DNA, 20 bp, Homo sapiens
gaaagagcttgtcgctgcgg

SEQ ID NO: 42417 - DNA, 24 bp, Homo sapiens
gaaagagcttgtcgctgcggtgtt

SEQ ID NO: 42418 - DNA, 18 bp, Homo sapiens
agagcttgtcgctgcggt

SEQ ID NO: 42419 - DNA, 20 bp, Homo sapiens
agagcttgtcgctgcggtgt

SEQ ID NO: 42420 - DNA, 24 bp, Homo sapiens
agagcttgtcgctgcggtgttgct

SEQ ID NO: 42421 - DNA, 21 bp, Homo sapiens
gagcttgtcgctgcggtgttg

SEQ ID NO: 42422 - DNA, 18 bp, Homo sapiens
cttgtcgctgcggtgttg

SEQ ID NO: 42423 - DNA, 26 bp, Homo sapiens
cttgtcgctgcggtgttgctgttgga

SEQ ID NO: 42424 - DNA, 22 bp, Homo sapiens
tgtcgctgcggtgttgctgttg

SEQ ID NO: 42425 - DNA, 18 bp, Homo sapiens
gtcgctgcggtgttgctg

SEQ ID NO: 42426 - DNA, 23 bp, Homo sapiens
gtcgctgcggtgttgctgttgga

SEQ ID NO: 42427 - DNA, 21 bp, Homo sapiens
cgctgcggtgttgctgttgga

SEQ ID NO: 42428 - DNA, 20 bp, Homo sapiens
gctgcggtgttgctgttgga

SEQ ID NO: 42429 - DNA, 19 bp, Homo sapiens
ctgcggtgttgctgttgga

SEQ ID NO: 42430 - DNA, 18 bp, Homo sapiens
tgcggtgttgctgttgga

SEQ ID NO: 42431 - DNA, 17 bp, Homo sapiens
gcggtgttgctgttgga

SEQ ID NO: 42432 - DNA, 16 bp, Homo sapiens
cggtgttgctgttgga

SEQ ID NO: 42433 - DNA, 22 bp, Homo sapiens
caatggcacaaactcattcttg

SEQ ID NO: 42434 - DNA, 22 bp, Homo sapiens
aatggcacaaactcattcttga

SEQ ID NO: 42435 - DNA, 23 bp, Homo sapiens
tactaactgcagattcaagtgag

SEQ ID NO: 42436 - DNA, 21 bp, Homo sapiens
actaactgcagattcaagtga

SEQ ID NO: 42437 - DNA, 21 bp, Homo sapiens
tactaactgcagattcaagtg

SEQ ID NO: 42438 - DNA, 20 bp, Homo sapiens
tactaactgcagattcaagt

SEQ ID NO: 42439 - DNA, 19 bp, Homo sapiens
tactaactgcagattcaag

SEQ ID NO: 42440 - DNA, 26 bp, Homo sapiens
tcagttccaggccaaccaggctggtt

SEQ ID NO: 42441 - DNA, 25 bp, Homo sapiens
tcagttccaggccaaccaggctggt

SEQ ID NO: 42442 - DNA, 22 bp, Homo sapiens
agttccaggccaaccaggctgg

SEQ ID NO: 42443 - DNA, 24 bp, Homo sapiens
tcagttccaggccaaccaggctgg

SEQ ID NO: 42444 - DNA, 21 bp, Homo sapiens
agttccaggccaaccaggctg

SEQ ID NO: 42445 - DNA, 23 bp, Homo sapiens
tcagttccaggccaaccaggctg

SEQ ID NO: 42446 - DNA, 21 bp, Homo sapiens
cagttccaggccaaccaggct

SEQ ID NO: 42447 - DNA, 20 bp, Homo sapiens
cagttccaggccaaccaggc

SEQ ID NO: 42448 - DNA, 21 bp, Homo sapiens
tcagttccaggccaaccaggc

SEQ ID NO: 42449 - DNA, 20 bp, Homo sapiens
tcagttccaggccaaccagg

SEQ ID NO: 42450 - DNA, 19 bp, Homo sapiens
tcagttccaggccaaccag

SEQ ID NO: 42451 - DNA, 27 bp, Homo sapiens
ttatggtttgcctgggactgaggaatt

SEQ ID NO: 42452 - DNA, 24 bp, Homo sapiens
ttatggtttgcctgggactgagga

SEQ ID NO: 42453 - DNA, 23 bp, Homo sapiens
ttatggtttgcctgggactgagg

SEQ ID NO: 42454 - DNA, 21 bp, Homo sapiens
tatggtttgcctgggactgag

SEQ ID NO: 42455 - DNA, 23 bp, Homo sapiens
attatggtttgcctgggactgag

SEQ ID NO: 42456 - DNA, 20 bp, Homo sapiens
tatggtttgcctgggactga

SEQ ID NO: 42457 - DNA, 21 bp, Homo sapiens
ttatggtttgcctgggactga

SEQ ID NO: 42458 - DNA, 22 bp, Homo sapiens
attatggtttgcctgggactga

SEQ ID NO: 42459 - DNA, 20 bp, Homo sapiens
ttatggtttgcctgggactg

SEQ ID NO: 42460 - DNA, 19 bp, Homo sapiens
ttatggtttgcctgggact

SEQ ID NO: 42461 - DNA, 18 bp, Homo sapiens
ttatggtttgcctgggac

SEQ ID NO: 42462 - DNA, 22 bp, Homo sapiens
aggtgcagtgctgcatctctgg

SEQ ID NO: 42463 - DNA, 17 bp, Homo sapiens
ggtgcagtgctgcatct

SEQ ID NO: 42464 - DNA, 18 bp, Homo sapiens
ggtgcagtgctgcatctc

SEQ ID NO: 42465 - DNA, 19 bp, Homo sapiens
ggtgcagtgctgcatctct

SEQ ID NO: 42466 - DNA, 20 bp, Homo sapiens
ggtgcagtgctgcatctctg

SEQ ID NO: 42467 - DNA, 21 bp, Homo sapiens
ggtgcagtgctgcatctctgg

SEQ ID NO: 42468 - DNA, 23 bp, Homo sapiens
ggtgcagtgctgcatctctggtc

SEQ ID NO: 42469 - DNA, 24 bp, Homo sapiens
ggtgcagtgctgcatctctggtca

SEQ ID NO: 42470 - DNA, 26 bp, Homo sapiens
ggtgcagtgctgcatctctggtcagt

SEQ ID NO: 42471 - DNA, 17 bp, Homo sapiens
tgagatgaagcactgta

SEQ ID NO: 42472 - DNA, 19 bp, Homo sapiens
tgagatgaagcactgtagc

SEQ ID NO: 42473 - DNA, 20 bp, Homo sapiens
tgagatgaagcactgtagct

SEQ ID NO: 42474 - DNA, 22 bp, Homo sapiens
tgagatgaagcactgtagctca

SEQ ID NO: 42475 - DNA, 23 bp, Homo sapiens
tgagatgaagcactgtagctcag

SEQ ID NO: 42476 - DNA, 25 bp, Homo sapiens
tgagatgaagcactgtagctcagga

SEQ ID NO: 42477 - DNA, 20 bp, Homo sapiens
gtccagttttcccaggaatc

SEQ ID NO: 42478 - DNA, 21 bp, Homo sapiens
gtccagttttcccaggaatcc

SEQ ID NO: 42479 - DNA, 22 bp, Homo sapiens
gtccagttttcccaggaatccc

SEQ ID NO: 42480 - DNA, 24 bp, Homo sapiens
gtccagttttcccaggaatccctt

SEQ ID NO: 42481 - DNA, 25 bp, Homo sapiens
gtccagttttcccaggaatccctta

SEQ ID NO: 42482 - DNA, 28 bp, Homo sapiens
gtccagttttcccaggaatcccttagat

SEQ ID NO: 42483 - DNA, 17 bp, Homo sapiens
ggattcctggaaatact

SEQ ID NO: 42484 - DNA, 18 bp, Homo sapiens
ggattcctggaaatactg

SEQ ID NO: 42485 - DNA, 20 bp, Homo sapiens
ggattcctggaaatactgtt

SEQ ID NO: 42486 - DNA, 21 bp, Homo sapiens
ggattcctggaaatactgttc

SEQ ID NO: 42487 - DNA, 23 bp, Homo sapiens
ggattcctggaaatactgttctt

SEQ ID NO: 42488 - DNA, 24 bp, Homo sapiens
ggattcctggaaatactgttcttg

SEQ ID NO: 42489 - DNA, 21 bp, Homo sapiens
gattcctggaaatactgttct

SEQ ID NO: 42490 - DNA, 22 bp, Homo sapiens
gattcctggaaatactgttctt

SEQ ID NO: 42491 - DNA, 18 bp, Homo sapiens
attcctggaaatactgtt

SEQ ID NO: 42492 - DNA, 19 bp, Homo sapiens
attcctggaaatactgttc

SEQ ID NO: 42493 - DNA, 20 bp, Homo sapiens
attcctggaaatactgttct

SEQ ID NO: 42494 - DNA, 21 bp, Homo sapiens
attcctggaaatactgttctt

SEQ ID NO: 42495 - DNA, 22 bp, Homo sapiens
attcctggaaatactgttcttg

SEQ ID NO: 42496 - DNA, 20 bp, Homo sapiens
ctcctgactccaggtcctgt

SEQ ID NO: 42497 - DNA, 21 bp, Homo sapiens
ctcctgactccaggtcctgtg

SEQ ID NO: 42498 - DNA, 23 bp, Homo sapiens
ctcctgactccaggtcctgtgtg

SEQ ID NO: 42499 - DNA, 24 bp, Homo sapiens
ctcctgactccaggtcctgtgtgt

SEQ ID NO: 42500 - DNA, 21 bp, Homo sapiens
tcctgactccaggtcctgtgt

SEQ ID NO: 42501 - DNA, 22 bp, Homo sapiens
tcctgactccaggtcctgtgtg

SEQ ID NO: 42502 - DNA, 27 bp, Homo sapiens
tcctgactccaggtcctgtgtgttacc

SEQ ID NO: 42503 - DNA, 22 bp, Homo sapiens
cctgactccaggtcctgtgtgt

SEQ ID NO: 42504 - DNA, 26 bp, Homo sapiens
cctgactccaggtcctgtgtgttacc

SEQ ID NO: 42505 - DNA, 16 bp, Homo sapiens
aatagcactggacttg

SEQ ID NO: 42506 - DNA, 27 bp, Homo sapiens
atagcactggacttggagtcagaaggc

SEQ ID NO: 42507 - DNA, 26 bp, Homo sapiens
tagcactggacttggagtcagaaggc

SEQ ID NO: 42508 - DNA, 23 bp, Homo sapiens
agcactggacttggagtcagaag

SEQ ID NO: 42509 - DNA, 24 bp, Homo sapiens
agcactggacttggagtcagaagg

SEQ ID NO: 42510 - DNA, 25 bp, Homo sapiens
agcactggacttggagtcagaaggc

SEQ ID NO: 42511 - DNA, 22 bp, Homo sapiens
gcactggacttggagtcagaag

SEQ ID NO: 42512 - DNA, 23 bp, Homo sapiens
gcactggacttggagtcagaagg

SEQ ID NO: 42513 - DNA, 24 bp, Homo sapiens
gcactggacttggagtcagaaggc

SEQ ID NO: 42514 - DNA, 27 bp, Homo sapiens
cactggacttggagtcagaaggcctga

SEQ ID NO: 42515 - DNA, 22 bp, Homo sapiens
actggacttggagtcagaaggc

SEQ ID NO: 42516 - DNA, 23 bp, Homo sapiens
actggacttggagtcagaaggcc

SEQ ID NO: 42517 - DNA, 24 bp, Homo sapiens
actggacttggagtcagaaggcct

SEQ ID NO: 42518 - DNA, 25 bp, Homo sapiens
actggacttggagtcagaaggcctg

SEQ ID NO: 42519 - DNA, 26 bp, Homo sapiens
actggacttggagtcagaaggcctga

SEQ ID NO: 42520 - DNA, 27 bp, Homo sapiens
actggacttggagtcagaaggcctgag

SEQ ID NO: 42521 - DNA, 25 bp, Homo sapiens
ctggacttggagtcagaaggcctga

SEQ ID NO: 42522 - DNA, 26 bp, Homo sapiens
ctggacttggagtcagaaggcctgag

SEQ ID NO: 42523 - DNA, 24 bp, Homo sapiens
agcagtgtttgttttgcccacagg

SEQ ID NO: 42524 - DNA, 21 bp, Homo sapiens
agcagtgtttgttttgcccac

SEQ ID NO: 42525 - DNA, 16 bp, Homo sapiens
ggtgacagcagtgttt

SEQ ID NO: 42526 - DNA, 19 bp, Homo sapiens
agagcactgcagttctgtt

SEQ ID NO: 42527 - DNA, 24 bp, Homo sapiens
tcgggcgcaagagcactgcagttc

SEQ ID NO: 42528 - DNA, 23 bp, Homo sapiens
tcgggcgcaagagcactgcagtt

SEQ ID NO: 42529 - DNA, 21 bp, Homo sapiens
tcgggcgcaagagcactgcag

SEQ ID NO: 42530 - DNA, 20 bp, Homo sapiens
tcgggcgcaagagcactgca

SEQ ID NO: 42531 - DNA, 22 bp, Homo sapiens
agtcgggcgcaagagcactgca

SEQ ID NO: 42532 - DNA, 19 bp, Homo sapiens
ctcagtcgggcgcaagagc

SEQ ID NO: 42533 - DNA, 21 bp, Homo sapiens
caggcggcattggtgtcaccc

SEQ ID NO: 42534 - DNA, 22 bp, Homo sapiens
tcctgtgaggttggcattgttg

SEQ ID NO: 42535 - DNA, 23 bp, Homo sapiens
tcctgtgaggttggcattgttgt

SEQ ID NO: 42536 - DNA, 21 bp, Homo sapiens
ctgtgaggttggcattgttgt

SEQ ID NO: 42537 - DNA, 18 bp, Homo sapiens
tgtgaggttggcattgtt

SEQ ID NO: 42538 - DNA, 19 bp, Homo sapiens
tgtgaggttggcattgttg

SEQ ID NO: 42539 - DNA, 20 bp, Homo sapiens
tgtgaggttggcattgttgt

SEQ ID NO: 42540 - DNA, 21 bp, Homo sapiens
tgtgaggttggcattgttgtc

SEQ ID NO: 42541 - DNA, 23 bp, Homo sapiens
tgtgaggttggcattgttgtctg

SEQ ID NO: 42542 - DNA, 25 bp, Homo sapiens
tgtgaggttggcattgttgtctggc

SEQ ID NO: 42543 - DNA, 24 bp, Homo sapiens
aaattttagagacggggtcttgct

SEQ ID NO: 42544 - DNA, 19 bp, Homo sapiens
aggaacactggacttggtg

SEQ ID NO: 42545 - DNA, 18 bp, Homo sapiens
actggacttggtgtcaga

SEQ ID NO: 42546 - DNA, 20 bp, Homo sapiens
actggacttggtgtcagatg

SEQ ID NO: 42547 - DNA, 22 bp, Homo sapiens
actggacttggtgtcagatggg

SEQ ID NO: 42548 - DNA, 23 bp, Homo sapiens
actggacttggtgtcagatggga

SEQ ID NO: 42549 - DNA, 24 bp, Homo sapiens
actggacttggtgtcagatgggat

SEQ ID NO: 42550 - DNA, 17 bp, Homo sapiens
cagatccttgggagccc

SEQ ID NO: 42551 - DNA, 19 bp, Homo sapiens
tccttgggagccctgttag

SEQ ID NO: 42552 - DNA, 20 bp, Homo sapiens
tccttgggagccctgttaga

SEQ ID NO: 42553 - DNA, 21 bp, Homo sapiens
tccttgggagccctgttagac

SEQ ID NO: 42554 - DNA, 22 bp, Homo sapiens
tccttgggagccctgttagact

SEQ ID NO: 42555 - DNA, 23 bp, Homo sapiens
tccttgggagccctgttagactc

SEQ ID NO: 42556 - DNA, 24 bp, Homo sapiens
tccttgggagccctgttagactct

SEQ ID NO: 42557 - DNA, 25 bp, Homo sapiens
tccttgggagccctgttagactctg

SEQ ID NO: 42558 - DNA, 26 bp, Homo sapiens
tccttgggagccctgttagactctgg

SEQ ID NO: 42559 - DNA, 17 bp, Homo sapiens
ccttgggagccctgtta

SEQ ID NO: 42560 - DNA, 20 bp, Homo sapiens
ccttgggagccctgttagac

SEQ ID NO: 42561 - DNA, 21 bp, Homo sapiens
ccttgggagccctgttagact

SEQ ID NO: 42562 - DNA, 22 bp, Homo sapiens
ccttgggagccctgttagactc

SEQ ID NO: 42563 - DNA, 23 bp, Homo sapiens
ccttgggagccctgttagactct

SEQ ID NO: 42564 - DNA, 26 bp, Homo sapiens
ccttgggagccctgttagactctgga

SEQ ID NO: 42565 - DNA, 27 bp, Homo sapiens
ccttgggagccctgttagactctggat

SEQ ID NO: 42566 - DNA, 28 bp, Homo sapiens
ccttgggagccctgttagactctggatt

SEQ ID NO: 42567 - DNA, 19 bp, Homo sapiens
ccctgttagactctggatt

SEQ ID NO: 42568 - DNA, 17 bp, Homo sapiens
ctgttagactctggatt

SEQ ID NO: 42569 - DNA, 16 bp, Homo sapiens
gtgaacgggcgccatc

SEQ ID NO: 42570 - DNA, 17 bp, Homo sapiens
gtgaacgggcgccatcc

SEQ ID NO: 42571 - DNA, 18 bp, Homo sapiens
gtgaacgggcgccatccc

SEQ ID NO: 42572 - DNA, 19 bp, Homo sapiens
gtgaacgggcgccatcccg

SEQ ID NO: 42573 - DNA, 20 bp, Homo sapiens
gtgaacgggcgccatcccga

SEQ ID NO: 42574 - DNA, 21 bp, Homo sapiens
gtgaacgggcgccatcccgag

SEQ ID NO: 42575 - DNA, 23 bp, Homo sapiens
gtgaacgggcgccatcccgaggc

SEQ ID NO: 42576 - DNA, 24 bp, Homo sapiens
gtgaacgggcgccatcccgaggct

SEQ ID NO: 42577 - DNA, 25 bp, Homo sapiens
gtgaacgggcgccatcccgaggctt

SEQ ID NO: 42578 - DNA, 26 bp, Homo sapiens
gtgaacgggcgccatcccgaggcttt

SEQ ID NO: 42579 - DNA, 20 bp, Homo sapiens
tgagaactgaattccatggg

SEQ ID NO: 42580 - DNA, 21 bp, Homo sapiens
tgagaactgaattccatgggt

SEQ ID NO: 42581 - DNA, 23 bp, Homo sapiens
tgagaactgaattccatgggttg

SEQ ID NO: 42582 - DNA, 24 bp, Homo sapiens
tgagaactgaattccatgggttgt

SEQ ID NO: 42583 - DNA, 26 bp, Homo sapiens
tgagaactgaattccatgggttgtgt

SEQ ID NO: 42584 - DNA, 27 bp, Homo sapiens
tgagaactgaattccatgggttgtgtc

SEQ ID NO: 42585 - DNA, 28 bp, Homo sapiens
tgagaactgaattccatgggttgtgtca

SEQ ID NO: 42586 - DNA, 21 bp, Homo sapiens
gagaactgaattccatgggtt

SEQ ID NO: 42587 - DNA, 22 bp, Homo sapiens
gagaactgaattccatgggttg

SEQ ID NO: 42588 - DNA, 23 bp, Homo sapiens
gagaactgaattccatgggttgt

SEQ ID NO: 42589 - DNA, 21 bp, Homo sapiens
agaactgaattccatgggttg

SEQ ID NO: 42590 - DNA, 20 bp, Homo sapiens
gacctctgaaattcagttct

SEQ ID NO: 42591 - DNA, 21 bp, Homo sapiens
gacctctgaaattcagttctt

SEQ ID NO: 42592 - DNA, 22 bp, Homo sapiens
gacctctgaaattcagttcttc

SEQ ID NO: 42593 - DNA, 23 bp, Homo sapiens
gacctctgaaattcagttcttca

SEQ ID NO: 42594 - DNA, 25 bp, Homo sapiens
gacctctgaaattcagttcttcagc

SEQ ID NO: 42595 - DNA, 19 bp, Homo sapiens
acctctgaaattcagttct

SEQ ID NO: 42596 - DNA, 20 bp, Homo sapiens
acctctgaaattcagttctt

SEQ ID NO: 42597 - DNA, 21 bp, Homo sapiens
acctctgaaattcagttcttc

SEQ ID NO: 42598 - DNA, 22 bp, Homo sapiens
acctctgaaattcagttcttca

SEQ ID NO: 42599 - DNA, 23 bp, Homo sapiens
acctctgaaattcagttcttcag

SEQ ID NO: 42600 - DNA, 24 bp, Homo sapiens
acctctgaaattcagttcttcagc

SEQ ID NO: 42601 - DNA, 21 bp, Homo sapiens
cctctgaaattcagttcttca

SEQ ID NO: 42602 - DNA, 23 bp, Homo sapiens
cctctgaaattcagttcttcagc

SEQ ID NO: 42603 - DNA, 22 bp, Homo sapiens
tctgaaattcagttcttcagct

SEQ ID NO: 42604 - DNA, 27 bp, Homo sapiens
agcagcattgtacagggctatgaaggc

SEQ ID NO: 42605 - DNA, 24 bp, Homo sapiens
cagcattgtacagggctatgaagg

SEQ ID NO: 42606 - DNA, 25 bp, Homo sapiens
gcagcattgtacagggctatgaagg

SEQ ID NO: 42607 - DNA, 26 bp, Homo sapiens
agcagcattgtacagggctatgaagg

SEQ ID NO: 42608 - DNA, 23 bp, Homo sapiens
cagcattgtacagggctatgaag

SEQ ID NO: 42609 - DNA, 24 bp, Homo sapiens
gcagcattgtacagggctatgaag

SEQ ID NO: 42610 - DNA, 25 bp, Homo sapiens
agcagcattgtacagggctatgaag

SEQ ID NO: 42611 - DNA, 21 bp, Homo sapiens
cagcattgtacagggctatga

SEQ ID NO: 42612 - DNA, 22 bp, Homo sapiens
agcagcattgtacagggctatg

SEQ ID NO: 42613 - DNA, 23 bp, Homo sapiens
agccctgtacaatgctgcttgat

SEQ ID NO: 42614 - DNA, 17 bp, Homo sapiens
tcaagcaccgcggaaag

SEQ ID NO: 42615 - DNA, 24 bp, Homo sapiens
catggttctgtcaagcaccgcgga

SEQ ID NO: 42616 - DNA, 22 bp, Homo sapiens
atggttctgtcaagcaccgcgg

SEQ ID NO: 42617 - DNA, 23 bp, Homo sapiens
catggttctgtcaagcaccgcgg

SEQ ID NO: 42618 - DNA, 21 bp, Homo sapiens
atggttctgtcaagcaccgcg

SEQ ID NO: 42619 - DNA, 21 bp, Homo sapiens
catggttctgtcaagcaccgc

SEQ ID NO: 42620 - DNA, 20 bp, Homo sapiens
catggttctgtcaagcaccg

SEQ ID NO: 42621 - DNA, 17 bp, Homo sapiens
catggttctgtcaagca

SEQ ID NO: 42622 - DNA, 27 bp, Homo sapiens
ttgtgcttgatctaaccatgtggtgga

SEQ ID NO: 42623 - DNA, 26 bp, Homo sapiens
ttgtgcttgatctaaccatgtggtgg

SEQ ID NO: 42624 - DNA, 25 bp, Homo sapiens
ttgtgcttgatctaaccatgtggtg

SEQ ID NO: 42625 - DNA, 23 bp, Homo sapiens
ttgtgcttgatctaaccatgtgg

SEQ ID NO: 42626 - DNA, 21 bp, Homo sapiens
tgtgcttgatctaaccatgtg

SEQ ID NO: 42627 - DNA, 22 bp, Homo sapiens
ttgtgcttgatctaaccatgtg

SEQ ID NO: 42628 - DNA, 20 bp, Homo sapiens
ttgtgcttgatctaaccatg

SEQ ID NO: 42629 - DNA, 18 bp, Homo sapiens
atctgtatgctagggctg

SEQ ID NO: 42630 - DNA, 21 bp, Homo sapiens
cgtatctgtatgctagggctg

SEQ ID NO: 42631 - DNA, 23 bp, Homo sapiens
ggcgtatctgtatgctagggctg

SEQ ID NO: 42632 - DNA, 22 bp, Homo sapiens
ggcgtatctgtatgctagggct

SEQ ID NO: 42633 - DNA, 24 bp, Homo sapiens
tgggcgtatctgtatgctagggct

SEQ ID NO: 42634 - DNA, 21 bp, Homo sapiens
ggcgtatctgtatgctagggc

SEQ ID NO: 42635 - DNA, 23 bp, Homo sapiens
tgggcgtatctgtatgctagggc

SEQ ID NO: 42636 - DNA, 24 bp, Homo sapiens
ttgggcgtatctgtatgctagggc

SEQ ID NO: 42637 - DNA, 22 bp, Homo sapiens
tgggcgtatctgtatgctaggg

SEQ ID NO: 42638 - DNA, 21 bp, Homo sapiens
tgggcgtatctgtatgctagg

SEQ ID NO: 42639 - DNA, 22 bp, Homo sapiens
ttgggcgtatctgtatgctagg

SEQ ID NO: 42640 - DNA, 20 bp, Homo sapiens
tgggcgtatctgtatgctag

SEQ ID NO: 42641 - DNA, 21 bp, Homo sapiens
ttgggcgtatctgtatgctag

SEQ ID NO: 42642 - DNA, 17 bp, Homo sapiens
gggcgtatctgtatgct

SEQ ID NO: 42643 - DNA, 18 bp, Homo sapiens
tgggcgtatctgtatgct

SEQ ID NO: 42644 - DNA, 23 bp, Homo sapiens
tagcacacagatacgcccagaga

SEQ ID NO: 42645 - DNA, 23 bp, Homo sapiens
ctagcacacagatacgcccagag

SEQ ID NO: 42646 - DNA, 21 bp, Homo sapiens
tagcacacagatacgcccaga

SEQ ID NO: 42647 - DNA, 23 bp, Homo sapiens
cctagcacacagatacgcccaga

SEQ ID NO: 42648 - DNA, 21 bp, Homo sapiens
ctagcacacagatacgcccag

SEQ ID NO: 42649 - DNA, 22 bp, Homo sapiens
cctagcacacagatacgcccag

SEQ ID NO: 42650 - DNA, 20 bp, Homo sapiens
ctagcacacagatacgccca

SEQ ID NO: 42651 - DNA, 21 bp, Homo sapiens
cctagcacacagatacgccca

SEQ ID NO: 42652 - DNA, 19 bp, Homo sapiens
ctagcacacagatacgccc

SEQ ID NO: 42653 - DNA, 16 bp, Homo sapiens
aagaccactggacttg

SEQ ID NO: 42654 - DNA, 26 bp, Homo sapiens
aagaccactggacttggagtcaggac

SEQ ID NO: 42655 - DNA, 20 bp, Homo sapiens
actggacttggagtcaggac

SEQ ID NO: 42656 - DNA, 21 bp, Homo sapiens
actggacttggagtcaggaca

SEQ ID NO: 42657 - DNA, 22 bp, Homo sapiens
actggacttggagtcaggacat

SEQ ID NO: 42658 - DNA, 23 bp, Homo sapiens
actggacttggagtcaggacatc

SEQ ID NO: 42659 - DNA, 25 bp, Homo sapiens
actggacttggagtcaggacatcat

SEQ ID NO: 42660 - DNA, 21 bp, Homo sapiens
ctggacttggagtcaggacat

SEQ ID NO: 42661 - DNA, 26 bp, Homo sapiens
taacgcataatatggacatgttataa

SEQ ID NO: 42662 - DNA, 22 bp, Homo sapiens
cgcataatatggacatgttata

SEQ ID NO: 42663 - DNA, 23 bp, Homo sapiens
acgcataatatggacatgttata

SEQ ID NO: 42664 - DNA, 24 bp, Homo sapiens
aacgcataatatggacatgttata

SEQ ID NO: 42665 - DNA, 25 bp, Homo sapiens
taacgcataatatggacatgttata

SEQ ID NO: 42666 - DNA, 21 bp, Homo sapiens
cgcataatatggacatgttat

SEQ ID NO: 42667 - DNA, 22 bp, Homo sapiens
acgcataatatggacatgttat

SEQ ID NO: 42668 - DNA, 22 bp, Homo sapiens
aacgcataatatggacatgtta

SEQ ID NO: 42669 - DNA, 23 bp, Homo sapiens
taacgcataatatggacatgtta

SEQ ID NO: 42670 - DNA, 21 bp, Homo sapiens
aacgcataatatggacatgtt

SEQ ID NO: 42671 - DNA, 22 bp, Homo sapiens
taacgcataatatggacatgtt

SEQ ID NO: 42672 - DNA, 19 bp, Homo sapiens
acgcataatatggacatgt

SEQ ID NO: 42673 - DNA, 20 bp, Homo sapiens
aacgcataatatggacatgt

SEQ ID NO: 42674 - DNA, 20 bp, Homo sapiens
taacgcataatatggacatg

SEQ ID NO: 42675 - DNA, 23 bp, Homo sapiens
atactaacgcataatatggacat

SEQ ID NO: 42676 - DNA, 22 bp, Homo sapiens
atactaacgcataatatggaca

SEQ ID NO: 42677 - DNA, 17 bp, Homo sapiens
atactaacgcataatat

SEQ ID NO: 42678 - DNA, 20 bp, Homo sapiens
tattatgggttagttgtgga

SEQ ID NO: 42679 - DNA, 22 bp, Homo sapiens
catattatgggttagttgtgga

SEQ ID NO: 42680 - DNA, 24 bp, Homo sapiens
tccatattatgggttagttgtgga

SEQ ID NO: 42681 - DNA, 22 bp, Homo sapiens
ccatattatgggttagttgtgg

SEQ ID NO: 42682 - DNA, 23 bp, Homo sapiens
tccatattatgggttagttgtgg

SEQ ID NO: 42683 - DNA, 22 bp, Homo sapiens
tccatattatgggttagttgtg

SEQ ID NO: 42684 - DNA, 22 bp, Homo sapiens
tgtccatattatgggttagttg

SEQ ID NO: 42685 - DNA, 22 bp, Homo sapiens
atgtccatattatgggttagtt

SEQ ID NO: 42686 - DNA, 20 bp, Homo sapiens
tgtccatattatgggttagt

SEQ ID NO: 42687 - DNA, 22 bp, Homo sapiens
catgtccatattatgggttagt

SEQ ID NO: 42688 - DNA, 23 bp, Homo sapiens
acatgtccatattatgggttagt

SEQ ID NO: 42689 - DNA, 19 bp, Homo sapiens
tgtccatattatgggttag

SEQ ID NO: 42690 - DNA, 21 bp, Homo sapiens
catgtccatattatgggttag

SEQ ID NO: 42691 - DNA, 22 bp, Homo sapiens
acatgtccatattatgggttag

SEQ ID NO: 42692 - DNA, 19 bp, Homo sapiens
catgtccatattatgggtt

SEQ ID NO: 42693 - DNA, 20 bp, Homo sapiens
acatgtccatattatgggtt

SEQ ID NO: 42694 - DNA, 22 bp, Homo sapiens
taacatgtccatattatgggtt

SEQ ID NO: 42695 - DNA, 17 bp, Homo sapiens
acatgtccatattatgg

SEQ ID NO: 42696 - DNA, 24 bp, Homo sapiens
gaggcagttctgagcacagtacac

SEQ ID NO: 42697 - DNA, 19 bp, Homo sapiens
tcacaacaaccttgcaggg

SEQ ID NO: 42698 - DNA, 20 bp, Homo sapiens
tcacaacaaccttgcagggt

SEQ ID NO: 42699 - DNA, 22 bp, Homo sapiens
tcacaacaaccttgcagggtag

SEQ ID NO: 42700 - DNA, 24 bp, Homo sapiens
tcacaacaaccttgcagggtagag

SEQ ID NO: 42701 - DNA, 21 bp, Homo sapiens
cacaacaaccttgcagggtag

SEQ ID NO: 42702 - DNA, 22 bp, Homo sapiens
cacaacaaccttgcagggtaga

SEQ ID NO: 42703 - DNA, 20 bp, Homo sapiens
acaacaaccttgcagggtag

SEQ ID NO: 42704 - DNA, 23 bp, Homo sapiens
acaacaaccttgcagggtagaga

SEQ ID NO: 42705 - DNA, 22 bp, Homo sapiens
ctacttttctaggttgttgggg

SEQ ID NO: 42706 - DNA, 19 bp, Homo sapiens
tacttttctaggttgttgg

SEQ ID NO: 42707 - DNA, 20 bp, Homo sapiens
tacttttctaggttgttggg

SEQ ID NO: 42708 - DNA, 22 bp, Homo sapiens
tacttttctaggttgttggggg

SEQ ID NO: 42709 - DNA, 23 bp, Homo sapiens
tacttttctaggttgttgggggc

SEQ ID NO: 42710 - DNA, 18 bp, Homo sapiens
cctgttcgtggattgtct

SEQ ID NO: 42711 - DNA, 21 bp, Homo sapiens
ctgttcgtggattgtctggat

SEQ ID NO: 42712 - DNA, 20 bp, Homo sapiens
cggcgcgaccggcccggggc

SEQ ID NO: 42713 - DNA, 21 bp, Homo sapiens
cggcgcgaccggcccggggct

SEQ ID NO: 42714 - DNA, 22 bp, Homo sapiens
cggcgcgaccggcccggggctc

SEQ ID NO: 42715 - DNA, 16 bp, Homo sapiens
ggcgcgaccggcccgg

SEQ ID NO: 42716 - DNA, 18 bp, Homo sapiens
ggcgcgaccggcccgggg

SEQ ID NO: 42717 - DNA, 21 bp, Homo sapiens
ggcgcgaccggcccggggctc

SEQ ID NO: 42718 - DNA, 19 bp, Homo sapiens
cgcgaccggcccggggctc

SEQ ID NO: 42719 - DNA, 22 bp, Homo sapiens
cgcgaccggcccggggctcttg

SEQ ID NO: 42720 - DNA, 21 bp, Homo sapiens
gcgaccggcccggggctcttg

SEQ ID NO: 42721 - DNA, 19 bp, Homo sapiens
cttggcacctagcaagcac

SEQ ID NO: 42722 - DNA, 20 bp, Homo sapiens
cttggcacctagcaagcact

SEQ ID NO: 42723 - DNA, 21 bp, Homo sapiens
cttggcacctagcaagcactc

SEQ ID NO: 42724 - DNA, 23 bp, Homo sapiens
cttggcacctagcaagcactcag

SEQ ID NO: 42725 - DNA, 23 bp, Homo sapiens
ctcaccactgccctcccacaggc

SEQ ID NO: 42726 - DNA, 22 bp, Homo sapiens
ctcaccactgccctcccacagg

SEQ ID NO: 42727 - DNA, 23 bp, Homo sapiens
tctcaccactgccctcccacagg

SEQ ID NO: 42728 - DNA, 24 bp, Homo sapiens
ctctcaccactgccctcccacagg

SEQ ID NO: 42729 - DNA, 24 bp, Homo sapiens
cctctcaccactgccctcccacag

SEQ ID NO: 42730 - DNA, 21 bp, Homo sapiens
tctcaccactgccctcccaca

SEQ ID NO: 42731 - DNA, 22 bp, Homo sapiens
ctctcaccactgccctcccaca

SEQ ID NO: 42732 - DNA, 23 bp, Homo sapiens
cctctcaccactgccctcccaca

SEQ ID NO: 42733 - DNA, 24 bp, Homo sapiens
ccctctcaccactgccctcccaca

SEQ ID NO: 42734 - DNA, 21 bp, Homo sapiens
ctctcaccactgccctcccac

SEQ ID NO: 42735 - DNA, 23 bp, Homo sapiens
ccctctcaccactgccctcccac

SEQ ID NO: 42736 - DNA, 19 bp, Homo sapiens
tctcaccactgccctccca

SEQ ID NO: 42737 - DNA, 20 bp, Homo sapiens
ctctcaccactgccctccca

SEQ ID NO: 42738 - DNA, 21 bp, Homo sapiens
cctctcaccactgccctccca

SEQ ID NO: 42739 - DNA, 21 bp, Homo sapiens
ccctctcaccactgccctccc

SEQ ID NO: 42740 - DNA, 19 bp, Homo sapiens
ttgggggagagcgtgggct

SEQ ID NO: 42741 - DNA, 22 bp, Homo sapiens
ggtttgggggagagcgtgggct

SEQ ID NO: 42742 - DNA, 20 bp, Homo sapiens
gtttgggggagagcgtgggc

SEQ ID NO: 42743 - DNA, 27 bp, Homo sapiens
gtgggtagggtttgggggagagcgtgg

SEQ ID NO: 42744 - DNA, 26 bp, Homo sapiens
gtgggtagggtttgggggagagcgtg

SEQ ID NO: 42745 - DNA, 17 bp, Homo sapiens
ggtttgggggagagcgt

SEQ ID NO: 42746 - DNA, 25 bp, Homo sapiens
gtgggtagggtttgggggagagcgt

SEQ ID NO: 42747 - DNA, 23 bp, Homo sapiens
tgggtagggtttgggggagagcg

SEQ ID NO: 42748 - DNA, 22 bp, Homo sapiens
tgggtagggtttgggggagagc

SEQ ID NO: 42749 - DNA, 23 bp, Homo sapiens
gtgggtagggtttgggggagagc

SEQ ID NO: 42750 - DNA, 21 bp, Homo sapiens
tgggtagggtttgggggagag

SEQ ID NO: 42751 - DNA, 22 bp, Homo sapiens
gtgggtagggtttgggggagag

SEQ ID NO: 42752 - DNA, 18 bp, Homo sapiens
ggtagggtttgggggaga

SEQ ID NO: 42753 - DNA, 21 bp, Homo sapiens
gtgggtagggtttgggggaga

SEQ ID NO: 42754 - DNA, 25 bp, Homo sapiens
ccgtctcagttactttatagccata

SEQ ID NO: 42755 - DNA, 26 bp, Homo sapiens
tccgtctcagttactttatagccata

SEQ ID NO: 42756 - DNA, 24 bp, Homo sapiens
tccgtctcagttactttatagcca

SEQ ID NO: 42757 - DNA, 22 bp, Homo sapiens
ccgtctcagttactttatagcc

SEQ ID NO: 42758 - DNA, 23 bp, Homo sapiens
tccgtctcagttactttatagcc

SEQ ID NO: 42759 - DNA, 24 bp, Homo sapiens
atccgtctcagttactttatagcc

SEQ ID NO: 42760 - DNA, 21 bp, Homo sapiens
ccgtctcagttactttatagc

SEQ ID NO: 42761 - DNA, 23 bp, Homo sapiens
atccgtctcagttactttatagc

SEQ ID NO: 42762 - DNA, 21 bp, Homo sapiens
tccgtctcagttactttatag

SEQ ID NO: 42763 - DNA, 22 bp, Homo sapiens
atccgtctcagttactttatag

SEQ ID NO: 42764 - DNA, 20 bp, Homo sapiens
tccgtctcagttactttata

SEQ ID NO: 42765 - DNA, 19 bp, Homo sapiens
tccgtctcagttactttat

SEQ ID NO: 42766 - DNA, 17 bp, Homo sapiens
atgagactgattgtcat

SEQ ID NO: 42767 - DNA, 26 bp, Homo sapiens
ttataaagcaatgagactgattgtca

SEQ ID NO: 42768 - DNA, 25 bp, Homo sapiens
ttataaagcaatgagactgattgtc

SEQ ID NO: 42769 - DNA, 24 bp, Homo sapiens
ttataaagcaatgagactgattgt

SEQ ID NO: 42770 - DNA, 23 bp, Homo sapiens
ttataaagcaatgagactgattg

SEQ ID NO: 42771 - DNA, 21 bp, Homo sapiens
ttataaagcaatgagactgat

SEQ ID NO: 42772 - DNA, 20 bp, Homo sapiens
ttataaagcaatgagactga

SEQ ID NO: 42773 - DNA, 18 bp, Homo sapiens
ttataaagcaatgagact

SEQ ID NO: 42774 - DNA, 24 bp, Homo sapiens
gacaccgctcagccggccgcggca

SEQ ID NO: 42775 - DNA, 25 bp, Homo sapiens
ctggacaccgctcagccggccgcgg

SEQ ID NO: 42776 - DNA, 26 bp, Homo sapiens
cctggacaccgctcagccggccgcgg

SEQ ID NO: 42777 - DNA, 24 bp, Homo sapiens
ctggacaccgctcagccggccgcg

SEQ ID NO: 42778 - DNA, 25 bp, Homo sapiens
cctggacaccgctcagccggccgcg

SEQ ID NO: 42779 - DNA, 23 bp, Homo sapiens
ctggacaccgctcagccggccgc

SEQ ID NO: 42780 - DNA, 24 bp, Homo sapiens
cctggacaccgctcagccggccgc

SEQ ID NO: 42781 - DNA, 22 bp, Homo sapiens
ctggacaccgctcagccggccg

SEQ ID NO: 42782 - DNA, 21 bp, Homo sapiens
ctggacaccgctcagccggcc

SEQ ID NO: 42783 - DNA, 22 bp, Homo sapiens
cctggacaccgctcagccggcc

SEQ ID NO: 42784 - DNA, 20 bp, Homo sapiens
ctggacaccgctcagccggc

SEQ ID NO: 42785 - DNA, 21 bp, Homo sapiens
cctggacaccgctcagccggc

SEQ ID NO: 42786 - DNA, 20 bp, Homo sapiens
cctggacaccgctcagccgg

SEQ ID NO: 42787 - DNA, 18 bp, Homo sapiens
cctggacaccgctcagcc

SEQ ID NO: 42788 - DNA, 17 bp, Homo sapiens
cctggacaccgctcagc

SEQ ID NO: 42789 - DNA, 20 bp, Homo sapiens
tgcggtggacaagtccggct

SEQ ID NO: 42790 - DNA, 21 bp, Homo sapiens
ctcggctgcggtggacaagtc

SEQ ID NO: 42791 - DNA, 20 bp, Homo sapiens
ctcggctgcggtggacaagt

SEQ ID NO: 42792 - DNA, 20 bp, Homo sapiens
actcggctgcggtggacaag

SEQ ID NO: 42793 - DNA, 24 bp, Homo sapiens
tgcggactcggctgcggtggacaa

SEQ ID NO: 42794 - DNA, 22 bp, Homo sapiens
gcggactcggctgcggtggaca

SEQ ID NO: 42795 - DNA, 23 bp, Homo sapiens
tgcggactcggctgcggtggaca

SEQ ID NO: 42796 - DNA, 22 bp, Homo sapiens
tgcggactcggctgcggtggac

SEQ ID NO: 42797 - DNA, 21 bp, Homo sapiens
tgcggactcggctgcggtgga

SEQ ID NO: 42798 - DNA, 19 bp, Homo sapiens
tgcggactcggctgcggtg

SEQ ID NO: 42799 - DNA, 26 bp, Homo sapiens
ttcatttggtataaaccgcgattatt

SEQ ID NO: 42800 - DNA, 27 bp, Homo sapiens
attcatttggtataaaccgcgattatt

SEQ ID NO: 42801 - DNA, 21 bp, Homo sapiens
tttggtataaaccgcgattat

SEQ ID NO: 42802 - DNA, 25 bp, Homo sapiens
ttcatttggtataaaccgcgattat

SEQ ID NO: 42803 - DNA, 24 bp, Homo sapiens
ttcatttggtataaaccgcgatta

SEQ ID NO: 42804 - DNA, 22 bp, Homo sapiens
tcatttggtataaaccgcgatt

SEQ ID NO: 42805 - DNA, 24 bp, Homo sapiens
attcatttggtataaaccgcgatt

SEQ ID NO: 42806 - DNA, 22 bp, Homo sapiens
ttcatttggtataaaccgcgat

SEQ ID NO: 42807 - DNA, 23 bp, Homo sapiens
attcatttggtataaaccgcgat

SEQ ID NO: 42808 - DNA, 21 bp, Homo sapiens
ttcatttggtataaaccgcga

SEQ ID NO: 42809 - DNA, 22 bp, Homo sapiens
attcatttggtataaaccgcga

SEQ ID NO: 42810 - DNA, 20 bp, Homo sapiens
ttcatttggtataaaccgcg

SEQ ID NO: 42811 - DNA, 18 bp, Homo sapiens
ttcatttggtataaaccg

SEQ ID NO: 42812 - DNA, 17 bp, Homo sapiens
ttcatttggtataaacc

SEQ ID NO: 42813 - DNA, 26 bp, Homo sapiens
tcgcggtttgtgccagatgacgattt

SEQ ID NO: 42814 - DNA, 23 bp, Homo sapiens
gcggtttgtgccagatgacgatt

SEQ ID NO: 42815 - DNA, 24 bp, Homo sapiens
cgcggtttgtgccagatgacgatt

SEQ ID NO: 42816 - DNA, 25 bp, Homo sapiens
tcgcggtttgtgccagatgacgatt

SEQ ID NO: 42817 - DNA, 24 bp, Homo sapiens
tcgcggtttgtgccagatgacgat

SEQ ID NO: 42818 - DNA, 23 bp, Homo sapiens
tcgcggtttgtgccagatgacga

SEQ ID NO: 42819 - DNA, 23 bp, Homo sapiens
atcgcggtttgtgccagatgacg

SEQ ID NO: 42820 - DNA, 21 bp, Homo sapiens
tcgcggtttgtgccagatgac

SEQ ID NO: 42821 - DNA, 22 bp, Homo sapiens
atcgcggtttgtgccagatgac

SEQ ID NO: 42822 - DNA, 20 bp, Homo sapiens
tcgcggtttgtgccagatga

SEQ ID NO: 42823 - DNA, 21 bp, Homo sapiens
atcgcggtttgtgccagatga

SEQ ID NO: 42824 - DNA, 22 bp, Homo sapiens
aatcgcggtttgtgccagatga

SEQ ID NO: 42825 - DNA, 24 bp, Homo sapiens
gtaatcgcggtttgtgccagatga

SEQ ID NO: 42826 - DNA, 21 bp, Homo sapiens
aatcgcggtttgtgccagatg

SEQ ID NO: 42827 - DNA, 23 bp, Homo sapiens
gtaatcgcggtttgtgccagatg

SEQ ID NO: 42828 - DNA, 19 bp, Homo sapiens
atcgcggtttgtgccagat

SEQ ID NO: 42829 - DNA, 20 bp, Homo sapiens
aatcgcggtttgtgccagat

SEQ ID NO: 42830 - DNA, 28 bp, Homo sapiens
ttgagaatgatgaatcattaggttccgg

SEQ ID NO: 42831 - DNA, 24 bp, Homo sapiens
tgagaatgatgaatcattaggttc

SEQ ID NO: 42832 - DNA, 25 bp, Homo sapiens
ttgagaatgatgaatcattaggttc

SEQ ID NO: 42833 - DNA, 26 bp, Homo sapiens
tttgagaatgatgaatcattaggttc

SEQ ID NO: 42834 - DNA, 25 bp, Homo sapiens
tttgagaatgatgaatcattaggtt

SEQ ID NO: 42835 - DNA, 22 bp, Homo sapiens
tgagaatgatgaatcattaggt

SEQ ID NO: 42836 - DNA, 23 bp, Homo sapiens
ttgagaatgatgaatcattaggt

SEQ ID NO: 42837 - DNA, 21 bp, Homo sapiens
tgagaatgatgaatcattagg

SEQ ID NO: 42838 - DNA, 23 bp, Homo sapiens
tttgagaatgatgaatcattagg

SEQ ID NO: 42839 - DNA, 21 bp, Homo sapiens
ttgagaatgatgaatcattag

SEQ ID NO: 42840 - DNA, 20 bp, Homo sapiens
ttgagaatgatgaatcatta

SEQ ID NO: 42841 - DNA, 19 bp, Homo sapiens
ttgagaatgatgaatcatt

SEQ ID NO: 42842 - DNA, 17 bp, Homo sapiens
cagactcagatatttaa

SEQ ID NO: 42843 - DNA, 22 bp, Homo sapiens
tgattcatcagactcagatatt

SEQ ID NO: 42844 - DNA, 25 bp, Homo sapiens
taatgattcatcagactcagatatt

SEQ ID NO: 42845 - DNA, 23 bp, Homo sapiens
taatgattcatcagactcagata

SEQ ID NO: 42846 - DNA, 20 bp, Homo sapiens
aatgattcatcagactcaga

SEQ ID NO: 42847 - DNA, 21 bp, Homo sapiens
taatgattcatcagactcaga

SEQ ID NO: 42848 - DNA, 20 bp, Homo sapiens
taatgattcatcagactcag

SEQ ID NO: 42849 - DNA, 19 bp, Homo sapiens
taatgattcatcagactca

SEQ ID NO: 42850 - DNA, 27 bp, Homo sapiens
tcttgtgttctctagatcagtgctttt

SEQ ID NO: 42851 - DNA, 22 bp, Homo sapiens
ttgtgttctctagatcagtgct

SEQ ID NO: 42852 - DNA, 23 bp, Homo sapiens
cttgtgttctctagatcagtgct

SEQ ID NO: 42853 - DNA, 21 bp, Homo sapiens
ttgtgttctctagatcagtgc

SEQ ID NO: 42854 - DNA, 22 bp, Homo sapiens
cttgtgttctctagatcagtgc

SEQ ID NO: 42855 - DNA, 23 bp, Homo sapiens
tcttgtgttctctagatcagtgc

SEQ ID NO: 42856 - DNA, 21 bp, Homo sapiens
cttgtgttctctagatcagtg

SEQ ID NO: 42857 - DNA, 22 bp, Homo sapiens
tcttgtgttctctagatcagtg

SEQ ID NO: 42858 - DNA, 20 bp, Homo sapiens
cttgtgttctctagatcagt

SEQ ID NO: 42859 - DNA, 20 bp, Homo sapiens
tcttgtgttctctagatcag

SEQ ID NO: 42860 - DNA, 27 bp, Homo sapiens
ccaggaggcggaggaggtggaggttgc

SEQ ID NO: 42861 - DNA, 25 bp, Homo sapiens
tggcagtgtattgttagctggttga

SEQ ID NO: 42862 - DNA, 24 bp, Homo sapiens
tggcagtgtattgttagctggttg

SEQ ID NO: 42863 - DNA, 18 bp, Homo sapiens
gtgtattgttagctggtt

SEQ ID NO: 42864 - DNA, 23 bp, Homo sapiens
tggcagtgtattgttagctggtt

SEQ ID NO: 42865 - DNA, 21 bp, Homo sapiens
tggcagtgtattgttagctgg

SEQ ID NO: 42866 - DNA, 20 bp, Homo sapiens
tggcagtgtattgttagctg

SEQ ID NO: 42867 - DNA, 19 bp, Homo sapiens
tggcagtgtattgttagct

SEQ ID NO: 42868 - DNA, 26 bp, Homo sapiens
cagccacaactaccctgccacttgct

SEQ ID NO: 42869 - DNA, 24 bp, Homo sapiens
cagccacaactaccctgccacttg

SEQ ID NO: 42870 - DNA, 25 bp, Homo sapiens
gcagccacaactaccctgccacttg

SEQ ID NO: 42871 - DNA, 23 bp, Homo sapiens
cagccacaactaccctgccactt

SEQ ID NO: 42872 - DNA, 21 bp, Homo sapiens
agccacaactaccctgccact

SEQ ID NO: 42873 - DNA, 23 bp, Homo sapiens
gcagccacaactaccctgccact

SEQ ID NO: 42874 - DNA, 21 bp, Homo sapiens
cagccacaactaccctgccac

SEQ ID NO: 42875 - DNA, 20 bp, Homo sapiens
cagccacaactaccctgcca

SEQ ID NO: 42876 - DNA, 21 bp, Homo sapiens
gcagccacaactaccctgcca

SEQ ID NO: 42877 - DNA, 28 bp, Homo sapiens
aggcagtgtattgttagctggctgcttg

SEQ ID NO: 42878 - DNA, 27 bp, Homo sapiens
aggcagtgtattgttagctggctgctt

SEQ ID NO: 42879 - DNA, 26 bp, Homo sapiens
aggcagtgtattgttagctggctgct

SEQ ID NO: 42880 - DNA, 25 bp, Homo sapiens
aggcagtgtattgttagctggctgc

SEQ ID NO: 42881 - DNA, 24 bp, Homo sapiens
aggcagtgtattgttagctggctg

SEQ ID NO: 42882 - DNA, 19 bp, Homo sapiens
agtgtattgttagctggct

SEQ ID NO: 42883 - DNA, 23 bp, Homo sapiens
aggcagtgtattgttagctggct

SEQ ID NO: 42884 - DNA, 21 bp, Homo sapiens
aggcagtgtattgttagctgg

SEQ ID NO: 42885 - DNA, 20 bp, Homo sapiens
aggcagtgtattgttagctg

SEQ ID NO: 42886 - DNA, 19 bp, Homo sapiens
aggcagtgtattgttagct

SEQ ID NO: 42887 - DNA, 18 bp, Homo sapiens
aggcagtgtattgttagc

SEQ ID NO: 42888 - DNA, 22 bp, Homo sapiens
gctagttgcactcctctctgtt

SEQ ID NO: 42889 - DNA, 23 bp, Homo sapiens
cagttgctagttgcactcctctc

SEQ ID NO: 42890 - DNA, 22 bp, Homo sapiens
cagttgctagttgcactcctct

SEQ ID NO: 42891 - DNA, 21 bp, Homo sapiens
cagttgctagttgcactcctc

SEQ ID NO: 42892 - DNA, 20 bp, Homo sapiens
cagttgctagttgcactcct

SEQ ID NO: 42893 - DNA, 27 bp, Homo sapiens
aggcagtgtattgctagcggctgttaa

SEQ ID NO: 42894 - DNA, 24 bp, Homo sapiens
gcagtgtattgctagcggctgtta

SEQ ID NO: 42895 - DNA, 26 bp, Homo sapiens
aggcagtgtattgctagcggctgtta

SEQ ID NO: 42896 - DNA, 27 bp, Homo sapiens
taggcagtgtattgctagcggctgtta

SEQ ID NO: 42897 - DNA, 25 bp, Homo sapiens
aggcagtgtattgctagcggctgtt

SEQ ID NO: 42898 - DNA, 24 bp, Homo sapiens
aggcagtgtattgctagcggctgt

SEQ ID NO: 42899 - DNA, 23 bp, Homo sapiens
aggcagtgtattgctagcggctg

SEQ ID NO: 42900 - DNA, 24 bp, Homo sapiens
taggcagtgtattgctagcggctg

SEQ ID NO: 42901 - DNA, 22 bp, Homo sapiens
aggcagtgtattgctagcggct

SEQ ID NO: 42902 - DNA, 23 bp, Homo sapiens
taggcagtgtattgctagcggct

SEQ ID NO: 42903 - DNA, 21 bp, Homo sapiens
aggcagtgtattgctagcggc

SEQ ID NO: 42904 - DNA, 18 bp, Homo sapiens
gcagtgtattgctagcgg

SEQ ID NO: 42905 - DNA, 20 bp, Homo sapiens
aggcagtgtattgctagcgg

SEQ ID NO: 42906 - DNA, 21 bp, Homo sapiens
taggcagtgtattgctagcgg

SEQ ID NO: 42907 - DNA, 17 bp, Homo sapiens
gcagtgtattgctagcg

SEQ ID NO: 42908 - DNA, 19 bp, Homo sapiens
aggcagtgtattgctagcg

SEQ ID NO: 42909 - DNA, 18 bp, Homo sapiens
aggcagtgtattgctagc

SEQ ID NO: 42910 - DNA, 18 bp, Homo sapiens
taggcagtgtattgctag

SEQ ID NO: 42911 - DNA, 21 bp, Homo sapiens
ttagaacgttttagggtcaaa

SEQ ID NO: 42912 - DNA, 19 bp, Homo sapiens
ttagaacgttttagggtca

SEQ ID NO: 42913 - DNA, 22 bp, Homo sapiens
actggttgaacaactgaaccca

SEQ ID NO: 42914 - DNA, 23 bp, Homo sapiens
aactggttgaacaactgaaccca

SEQ ID NO: 42915 - DNA, 24 bp, Homo sapiens
taactggttgaacaactgaaccca

SEQ ID NO: 42916 - DNA, 22 bp, Homo sapiens
aactggttgaacaactgaaccc

SEQ ID NO: 42917 - DNA, 23 bp, Homo sapiens
taactggttgaacaactgaaccc

SEQ ID NO: 42918 - DNA, 21 bp, Homo sapiens
aactggttgaacaactgaacc

SEQ ID NO: 42919 - DNA, 20 bp, Homo sapiens
aactggttgaacaactgaac

SEQ ID NO: 42920 - DNA, 21 bp, Homo sapiens
taactggttgaacaactgaac

SEQ ID NO: 42921 - DNA, 20 bp, Homo sapiens
taactggttgaacaactgaa

SEQ ID NO: 42922 - DNA, 19 bp, Homo sapiens
taactggttgaacaactga

SEQ ID NO: 42923 - DNA, 25 bp, Homo sapiens
acagttgttcaaccagttactaatc

SEQ ID NO: 42924 - DNA, 27 bp, Homo sapiens
ttacagttgttcaaccagttactaatc

SEQ ID NO: 42925 - DNA, 26 bp, Homo sapiens
ttacagttgttcaaccagttactaat

SEQ ID NO: 42926 - DNA, 24 bp, Homo sapiens
tacagttgttcaaccagttactaa

SEQ ID NO: 42927 - DNA, 25 bp, Homo sapiens
ttacagttgttcaaccagttactaa

SEQ ID NO: 42928 - DNA, 23 bp, Homo sapiens
tacagttgttcaaccagttacta

SEQ ID NO: 42929 - DNA, 24 bp, Homo sapiens
ttacagttgttcaaccagttacta

SEQ ID NO: 42930 - DNA, 21 bp, Homo sapiens
acagttgttcaaccagttact

SEQ ID NO: 42931 - DNA, 22 bp, Homo sapiens
tacagttgttcaaccagttact

SEQ ID NO: 42932 - DNA, 20 bp, Homo sapiens
acagttgttcaaccagttac

SEQ ID NO: 42933 - DNA, 22 bp, Homo sapiens
ttacagttgttcaaccagttac

SEQ ID NO: 42934 - DNA, 20 bp, Homo sapiens
tacagttgttcaaccagtta

SEQ ID NO: 42935 - DNA, 21 bp, Homo sapiens
ttacagttgttcaaccagtta

SEQ ID NO: 42936 - DNA, 22 bp, Homo sapiens
attacagttgttcaaccagtta

SEQ ID NO: 42937 - DNA, 20 bp, Homo sapiens
ttacagttgttcaaccagtt

SEQ ID NO: 42938 - DNA, 25 bp, Homo sapiens
tttaacataatagtgtggattgaat

SEQ ID NO: 42939 - DNA, 19 bp, Homo sapiens
taacataatagtgtggatt

SEQ ID NO: 42940 - DNA, 20 bp, Homo sapiens
taacataatagtgtggattg

SEQ ID NO: 42941 - DNA, 22 bp, Homo sapiens
taacataatagtgtggattgaa

SEQ ID NO: 42942 - DNA, 23 bp, Homo sapiens
taacataatagtgtggattgaat

SEQ ID NO: 42943 - DNA, 24 bp, Homo sapiens
taacataatagtgtggattgaatc

SEQ ID NO: 42944 - DNA, 20 bp, Homo sapiens
atagtgtggattgaatcaca

SEQ ID NO: 42945 - DNA, 16 bp, Homo sapiens
tgtggattgaatcaca

SEQ ID NO: 42946 - DNA, 19 bp, Homo sapiens
tttggacggtaaggttaag

SEQ ID NO: 42947 - DNA, 20 bp, Homo sapiens
tttggacggtaaggttaagc

SEQ ID NO: 42948 - DNA, 21 bp, Homo sapiens
tttggacggtaaggttaagca

SEQ ID NO: 42949 - DNA, 22 bp, Homo sapiens
tttggacggtaaggttaagcaa

SEQ ID NO: 42950 - DNA, 23 bp, Homo sapiens
tttggacggtaaggttaagcaag

SEQ ID NO: 42951 - DNA, 24 bp, Homo sapiens
tttggacggtaaggttaagcaagg

SEQ ID NO: 42952 - DNA, 19 bp, Homo sapiens
ttggacggtaaggttaagc

SEQ ID NO: 42953 - DNA, 22 bp, Homo sapiens
ttggacggtaaggttaagcaag

SEQ ID NO: 42954 - DNA, 23 bp, Homo sapiens
ttggacggtaaggttaagcaagg

SEQ ID NO: 42955 - DNA, 21 bp, Homo sapiens
tggacggtaaggttaagcaag

SEQ ID NO: 42956 - DNA, 20 bp, Homo sapiens
ttgcttaaccttgccctcga

SEQ ID NO: 42957 - DNA, 21 bp, Homo sapiens
ttgcttaaccttgccctcgaa

SEQ ID NO: 42958 - DNA, 22 bp, Homo sapiens
ttgcttaaccttgccctcgaaa

SEQ ID NO: 42959 - DNA, 23 bp, Homo sapiens
ttgcttaaccttgccctcgaaat

SEQ ID NO: 42960 - DNA, 19 bp, Homo sapiens
tgcttaaccttgccctcga

SEQ ID NO: 42961 - DNA, 20 bp, Homo sapiens
tgcttaaccttgccctcgaa

SEQ ID NO: 42962 - DNA, 22 bp, Homo sapiens
tgcttaaccttgccctcgaaat

SEQ ID NO: 42963 - DNA, 23 bp, Homo sapiens
tgcttaaccttgccctcgaaata

SEQ ID NO: 42964 - DNA, 19 bp, Homo sapiens
gcgcacagaggtaggtgtg

SEQ ID NO: 42965 - DNA, 24 bp, Homo sapiens
gcgcacagaggtaggtgtggaaga

SEQ ID NO: 42966 - DNA, 17 bp, Homo sapiens
acagaggtaggtgtgga

SEQ ID NO: 42967 - DNA, 18 bp, Homo sapiens
acagaggtaggtgtggaa

SEQ ID NO: 42968 - DNA, 18 bp, Homo sapiens
agaggtaggtgtggaaga

SEQ ID NO: 42969 - DNA, 20 bp, Homo sapiens
agaggtaggtgtggaagaaa

SEQ ID NO: 42970 - DNA, 17 bp, Homo sapiens
gaggtaggtgtggaaga

SEQ ID NO: 42971 - DNA, 18 bp, Homo sapiens
gaggtaggtgtggaagaa

SEQ ID NO: 42972 - DNA, 19 bp, Homo sapiens
gaggtaggtgtggaagaaa

SEQ ID NO: 42973 - DNA, 20 bp, Homo sapiens
taggtgtggaagaaagtgaa

SEQ ID NO: 42974 - DNA, 18 bp, Homo sapiens
tgcatgtgatgaagcaaa

SEQ ID NO: 42975 - DNA, 20 bp, Homo sapiens
tgcatgtgatgaagcaaatc

SEQ ID NO: 42976 - DNA, 21 bp, Homo sapiens
tgcatgtgatgaagcaaatca

SEQ ID NO: 42977 - DNA, 23 bp, Homo sapiens
tgcatgtgatgaagcaaatcagt

SEQ ID NO: 42978 - DNA, 24 bp, Homo sapiens
tgcatgtgatgaagcaaatcagta

SEQ ID NO: 42979 - DNA, 26 bp, Homo sapiens
tgcatgtgatgaagcaaatcagtatg

SEQ ID NO: 42980 - DNA, 16 bp, Homo sapiens
gcatgtgatgaagcaa

SEQ ID NO: 42981 - DNA, 17 bp, Homo sapiens
gcatgtgatgaagcaaa

SEQ ID NO: 42982 - DNA, 18 bp, Homo sapiens
gcatgtgatgaagcaaat

SEQ ID NO: 42983 - DNA, 19 bp, Homo sapiens
gcatgtgatgaagcaaatc

SEQ ID NO: 42984 - DNA, 20 bp, Homo sapiens
gcatgtgatgaagcaaatca

SEQ ID NO: 42985 - DNA, 21 bp, Homo sapiens
gcatgtgatgaagcaaatcag

SEQ ID NO: 42986 - DNA, 23 bp, Homo sapiens
gcatgtgatgaagcaaatcagta

SEQ ID NO: 42987 - DNA, 24 bp, Homo sapiens
gcatgtgatgaagcaaatcagtat

SEQ ID NO: 42988 - DNA, 25 bp, Homo sapiens
gcatgtgatgaagcaaatcagtatg

SEQ ID NO: 42989 - DNA, 26 bp, Homo sapiens
gcatgtgatgaagcaaatcagtatga

SEQ ID NO: 42990 - DNA, 27 bp, Homo sapiens
gcatgtgatgaagcaaatcagtatgaa

SEQ ID NO: 42991 - DNA, 28 bp, Homo sapiens
gcatgtgatgaagcaaatcagtatgaat

SEQ ID NO: 42992 - DNA, 17 bp, Homo sapiens
catgatactgtaaacgc

SEQ ID NO: 42993 - DNA, 18 bp, Homo sapiens
catgatactgtaaacgct

SEQ ID NO: 42994 - DNA, 19 bp, Homo sapiens
catgatactgtaaacgctt

SEQ ID NO: 42995 - DNA, 21 bp, Homo sapiens
catgatactgtaaacgctttc

SEQ ID NO: 42996 - DNA, 22 bp, Homo sapiens
catgatactgtaaacgctttct

SEQ ID NO: 42997 - DNA, 23 bp, Homo sapiens
catgatactgtaaacgctttctg

SEQ ID NO: 42998 - DNA, 24 bp, Homo sapiens
catgatactgtaaacgctttctga

SEQ ID NO: 42999 - DNA, 26 bp, Homo sapiens
catgatactgtaaacgctttctgatg

SEQ ID NO: 43000 - DNA, 27 bp, Homo sapiens
catgatactgtaaacgctttctgatgt

SEQ ID NO: 43001 - DNA, 25 bp, Homo sapiens
atgatactgtaaacgctttctgatg

SEQ ID NO: 43002 - DNA, 19 bp, Homo sapiens
tgatactgtaaacgctttc

SEQ ID NO: 43003 - DNA, 20 bp, Homo sapiens
tgatactgtaaacgctttct

SEQ ID NO: 43004 - DNA, 24 bp, Homo sapiens
tgatactgtaaacgctttctgatg

SEQ ID NO: 43005 - DNA, 19 bp, Homo sapiens
gatactgtaaacgctttct

SEQ ID NO: 43006 - DNA, 23 bp, Homo sapiens
gatactgtaaacgctttctgatg

SEQ ID NO: 43007 - DNA, 25 bp, Homo sapiens
gatactgtaaacgctttctgatgta

SEQ ID NO: 43008 - DNA, 28 bp, Homo sapiens
gatactgtaaacgctttctgatgtacta

SEQ ID NO: 43009 - DNA, 20 bp, Homo sapiens
atactgtaaacgctttctga

SEQ ID NO: 43010 - DNA, 21 bp, Homo sapiens
atactgtaaacgctttctgat

SEQ ID NO: 43011 - DNA, 22 bp, Homo sapiens
atactgtaaacgctttctgatg

SEQ ID NO: 43012 - DNA, 21 bp, Homo sapiens
tactgtaaacgctttctgatg

SEQ ID NO: 43013 - DNA, 24 bp, Homo sapiens
tactgtaaacgctttctgatgtac

SEQ ID NO: 43014 - DNA, 19 bp, Homo sapiens
ctgtaaacgctttctgatg

SEQ ID NO: 43015 - DNA, 20 bp, Homo sapiens
ctgtaaacgctttctgatgt

SEQ ID NO: 43016 - DNA, 24 bp, Homo sapiens
ctgtaaacgctttctgatgtacta

SEQ ID NO: 43017 - DNA, 18 bp, Homo sapiens
tgtaaacgctttctgatg

SEQ ID NO: 43018 - DNA, 17 bp, Homo sapiens
gtaaacgctttctgatg

SEQ ID NO: 43019 - DNA, 22 bp, Homo sapiens
gtaaacgctttctgatgtacta

SEQ ID NO: 43020 - DNA, 27 bp, Homo sapiens
taaagctagataaccgaaagtaaaaac

SEQ ID NO: 43021 - DNA, 28 bp, Homo sapiens
ataaagctagataaccgaaagtaaaaac

SEQ ID NO: 43022 - DNA, 16 bp, Homo sapiens
agctgtatgagtgtat

SEQ ID NO: 43023 - DNA, 17 bp, Homo sapiens
tagctgtatgagtgtat

SEQ ID NO: 43024 - DNA, 18 bp, Homo sapiens
ctagctgtatgagtgtat

SEQ ID NO: 43025 - DNA, 28 bp, Homo sapiens
ctttggttatctagctgtatgagtgtat

SEQ ID NO: 43026 - DNA, 20 bp, Homo sapiens
tatctagctgtatgagtgta

SEQ ID NO: 43027 - DNA, 28 bp, Homo sapiens
tctttggttatctagctgtatgagtgta

SEQ ID NO: 43028 - DNA, 25 bp, Homo sapiens
tttggttatctagctgtatgagtgt

SEQ ID NO: 43029 - DNA, 26 bp, Homo sapiens
ctttggttatctagctgtatgagtgt

SEQ ID NO: 43030 - DNA, 27 bp, Homo sapiens
tctttggttatctagctgtatgagtgt

SEQ ID NO: 43031 - DNA, 23 bp, Homo sapiens
actgacaggagagcattttgact

SEQ ID NO: 43032 - DNA, 22 bp, Homo sapiens
actgacaggagagcattttgac

SEQ ID NO: 43033 - DNA, 19 bp, Homo sapiens
tgacaggagagcattttga

SEQ ID NO: 43034 - DNA, 22 bp, Homo sapiens
cactgacaggagagcattttga

SEQ ID NO: 43035 - DNA, 18 bp, Homo sapiens
actgacaggagagcattt

SEQ ID NO: 43036 - DNA, 24 bp, Homo sapiens
actcgtgttcaaagcctttagccc

SEQ ID NO: 43037 - DNA, 25 bp, Homo sapiens
aactcgtgttcaaagcctttagccc

SEQ ID NO: 43038 - DNA, 22 bp, Homo sapiens
ctcgtgttcaaagcctttagcc

SEQ ID NO: 43039 - DNA, 23 bp, Homo sapiens
actcgtgttcaaagcctttagcc

SEQ ID NO: 43040 - DNA, 24 bp, Homo sapiens
aactcgtgttcaaagcctttagcc

SEQ ID NO: 43041 - DNA, 22 bp, Homo sapiens
actcgtgttcaaagcctttagc

SEQ ID NO: 43042 - DNA, 23 bp, Homo sapiens
aactcgtgttcaaagcctttagc

SEQ ID NO: 43043 - DNA, 20 bp, Homo sapiens
actcgtgttcaaagccttta

SEQ ID NO: 43044 - DNA, 21 bp, Homo sapiens
aactcgtgttcaaagccttta

SEQ ID NO: 43045 - DNA, 19 bp, Homo sapiens
actcgtgttcaaagccttt

SEQ ID NO: 43046 - DNA, 20 bp, Homo sapiens
aactcgtgttcaaagccttt

SEQ ID NO: 43047 - DNA, 19 bp, Homo sapiens
aactcgtgttcaaagcctt

SEQ ID NO: 43048 - DNA, 25 bp, Homo sapiens
tgacagcgccctgcctggctcggcc

SEQ ID NO: 43049 - DNA, 24 bp, Homo sapiens
tgacagcgccctgcctggctcggc

SEQ ID NO: 43050 - DNA, 25 bp, Homo sapiens
ctgacagcgccctgcctggctcggc

SEQ ID NO: 43051 - DNA, 22 bp, Homo sapiens
gacagcgccctgcctggctcgg

SEQ ID NO: 43052 - DNA, 23 bp, Homo sapiens
tgacagcgccctgcctggctcgg

SEQ ID NO: 43053 - DNA, 24 bp, Homo sapiens
ctgacagcgccctgcctggctcgg

SEQ ID NO: 43054 - DNA, 22 bp, Homo sapiens
tgacagcgccctgcctggctcg

SEQ ID NO: 43055 - DNA, 23 bp, Homo sapiens
ctgacagcgccctgcctggctcg

SEQ ID NO: 43056 - DNA, 22 bp, Homo sapiens
ctgacagcgccctgcctggctc

SEQ ID NO: 43057 - DNA, 20 bp, Homo sapiens
tgacagcgccctgcctggct

SEQ ID NO: 43058 - DNA, 21 bp, Homo sapiens
ctgacagcgccctgcctggct

SEQ ID NO: 43059 - DNA, 19 bp, Homo sapiens
tgacagcgccctgcctggc

SEQ ID NO: 43060 - DNA, 20 bp, Homo sapiens
ctgacagcgccctgcctggc

SEQ ID NO: 43061 - DNA, 17 bp, Homo sapiens
tgacagcgccctgcctg

SEQ ID NO: 43062 - DNA, 27 bp, Homo sapiens
agcgcgggctgagcgctgccagtcagc

SEQ ID NO: 43063 - DNA, 26 bp, Homo sapiens
agcgcgggctgagcgctgccagtcag

SEQ ID NO: 43064 - DNA, 23 bp, Homo sapiens
cgcgggctgagcgctgccagtca

SEQ ID NO: 43065 - DNA, 24 bp, Homo sapiens
gcgcgggctgagcgctgccagtca

SEQ ID NO: 43066 - DNA, 25 bp, Homo sapiens
agcgcgggctgagcgctgccagtca

SEQ ID NO: 43067 - DNA, 23 bp, Homo sapiens
agcgcgggctgagcgctgccagt

SEQ ID NO: 43068 - DNA, 22 bp, Homo sapiens
agcgcgggctgagcgctgccag

SEQ ID NO: 43069 - DNA, 21 bp, Homo sapiens
agcgcgggctgagcgctgcca

SEQ ID NO: 43070 - DNA, 20 bp, Homo sapiens
agcgcgggctgagcgctgcc

SEQ ID NO: 43071 - DNA, 19 bp, Homo sapiens
agcgcgggctgagcgctgc

SEQ ID NO: 43072 - DNA, 21 bp, Homo sapiens
tgagcgcgggctgagcgctgc

SEQ ID NO: 43073 - DNA, 18 bp, Homo sapiens
agcgcgggctgagcgctg

SEQ ID NO: 43074 - DNA, 17 bp, Homo sapiens
agcgcgggctgagcgct

SEQ ID NO: 43075 - DNA, 23 bp, Homo sapiens
caaagaggaaggtcccattactg

SEQ ID NO: 43076 - DNA, 22 bp, Homo sapiens
aaagaggaaggtcccattactg

SEQ ID NO: 43077 - DNA, 21 bp, Homo sapiens
aagaggaaggtcccattactg

SEQ ID NO: 43078 - DNA, 17 bp, Homo sapiens
aggtcccattactgcag

SEQ ID NO: 43079 - DNA, 23 bp, Homo sapiens
agcatacacctgtagtcctagat

SEQ ID NO: 43080 - DNA, 24 bp, Homo sapiens
agcatacacctgtagtcctagata

SEQ ID NO: 43081 - DNA, 24 bp, Homo sapiens
caagaacctcagttgcttttgtgc

SEQ ID NO: 43082 - DNA, 23 bp, Homo sapiens
caagaacctcagttgcttttgtg

SEQ ID NO: 43083 - DNA, 19 bp, Homo sapiens
gaacctcagttgcttttgt

SEQ ID NO: 43084 - DNA, 20 bp, Homo sapiens
agaacctcagttgcttttgt

SEQ ID NO: 43085 - DNA, 21 bp, Homo sapiens
aagaacctcagttgcttttgt

SEQ ID NO: 43086 - DNA, 21 bp, Homo sapiens
caagaacctcagttgcttttg

SEQ ID NO: 43087 - DNA, 20 bp, Homo sapiens
caagaacctcagttgctttt

SEQ ID NO: 43088 - DNA, 19 bp, Homo sapiens
caagaacctcagttgcttt

SEQ ID NO: 43089 - DNA, 18 bp, Homo sapiens
caagaacctcagttgctt

SEQ ID NO: 43090 - DNA, 17 bp, Homo sapiens
caagaacctcagttgct

SEQ ID NO: 43091 - DNA, 27 bp, Homo sapiens
aaaagtaattgtggttttggcctttat

SEQ ID NO: 43092 - DNA, 25 bp, Homo sapiens
aaaagtaattgtggttttggccttt

SEQ ID NO: 43093 - DNA, 21 bp, Homo sapiens
aaggggaccaaagagatatat

SEQ ID NO: 43094 - DNA, 22 bp, Homo sapiens
aaggggaccaaagagatatata

SEQ ID NO: 43095 - DNA, 23 bp, Homo sapiens
aaggggaccaaagagatatatag

SEQ ID NO: 43096 - DNA, 26 bp, Homo sapiens
aaggggaccaaagagatatatagata

SEQ ID NO: 43097 - DNA, 23 bp, Homo sapiens
aggggaccaaagagatatataga

SEQ ID NO: 43098 - DNA, 25 bp, Homo sapiens
aggggaccaaagagatatatagata

SEQ ID NO: 43099 - DNA, 21 bp, Homo sapiens
ggggaccaaagagatatatag

SEQ ID NO: 43100 - DNA, 20 bp, Homo sapiens
gggaccaaagagatatatag

SEQ ID NO: 43101 - DNA, 18 bp, Homo sapiens
gaccaaagagatatatag

SEQ ID NO: 43102 - DNA, 18 bp, Homo sapiens
tatatacctgttcggtct

SEQ ID NO: 43103 - DNA, 20 bp, Homo sapiens
tatatacctgttcggtctct

SEQ ID NO: 43104 - DNA, 21 bp, Homo sapiens
tatatacctgttcggtctctt

SEQ ID NO: 43105 - DNA, 22 bp, Homo sapiens
tatatacctgttcggtctcttt

SEQ ID NO: 43106 - DNA, 23 bp, Homo sapiens
tatatacctgttcggtctcttta

SEQ ID NO: 43107 - DNA, 19 bp, Homo sapiens
atatacctgttcggtctct

SEQ ID NO: 43108 - DNA, 20 bp, Homo sapiens
atatacctgttcggtctctt

SEQ ID NO: 43109 - DNA, 21 bp, Homo sapiens
atatacctgttcggtctcttt

SEQ ID NO: 43110 - DNA, 23 bp, Homo sapiens
atatacctgttcggtctctttaa

SEQ ID NO: 43111 - DNA, 19 bp, Homo sapiens
tatacctgttcggtctctt

SEQ ID NO: 43112 - DNA, 20 bp, Homo sapiens
tatacctgttcggtctcttt

SEQ ID NO: 43113 - DNA, 21 bp, Homo sapiens
tatacctgttcggtctcttta

SEQ ID NO: 43114 - DNA, 22 bp, Homo sapiens
tatacctgttcggtctctttaa

SEQ ID NO: 43115 - DNA, 19 bp, Homo sapiens
atacctgttcggtctcttt

SEQ ID NO: 43116 - DNA, 21 bp, Homo sapiens
atacctgttcggtctctttaa

SEQ ID NO: 43117 - DNA, 18 bp, Homo sapiens
tggccacaatgggttaga

SEQ ID NO: 43118 - DNA, 19 bp, Homo sapiens
tggccacaatgggttagaa

SEQ ID NO: 43119 - DNA, 20 bp, Homo sapiens
tggccacaatgggttagaac

SEQ ID NO: 43120 - DNA, 21 bp, Homo sapiens
tggccacaatgggttagaaca

SEQ ID NO: 43121 - DNA, 22 bp, Homo sapiens
tggccacaatgggttagaacac

SEQ ID NO: 43122 - DNA, 23 bp, Homo sapiens
tggccacaatgggttagaacact

SEQ ID NO: 43123 - DNA, 26 bp, Homo sapiens
tggccacaatgggttagaacactatt

SEQ ID NO: 43124 - DNA, 20 bp, Homo sapiens
ggccacaatgggttagaaca

SEQ ID NO: 43125 - DNA, 26 bp, Homo sapiens
cacaaaagtaatcgcggtttttgtca

SEQ ID NO: 43126 - DNA, 23 bp, Homo sapiens
gatgagtagtgactgatgaagca

SEQ ID NO: 43127 - DNA, 22 bp, Homo sapiens
gatgagtagtgactgatgaagc

SEQ ID NO: 43128 - DNA, 28 bp, Homo sapiens
gaaaatgatgagtagtgactgatgaagc

SEQ ID NO: 43129 - DNA, 26 bp, Homo sapiens
gaaaatgatgagtagtgactgatgaa

SEQ ID NO: 43130 - DNA, 26 bp, Homo sapiens
tgaaaatgatgagtagtgactgatga

SEQ ID NO: 43131 - DNA, 18 bp, Homo sapiens
gatgagtagtgactgatg

SEQ ID NO: 43132 - DNA, 23 bp, Homo sapiens
aaaatgatgagtagtgactgatg

SEQ ID NO: 43133 - DNA, 25 bp, Homo sapiens
tgaaaatgatgagtagtgactgatg

SEQ ID NO: 43134 - DNA, 23 bp, Homo sapiens
gaaaatgatgagtagtgactgat

SEQ ID NO: 43135 - DNA, 21 bp, Homo sapiens
gaaaatgatgagtagtgactg

SEQ ID NO: 43136 - DNA, 20 bp, Homo sapiens
gaaaatgatgagtagtgact

SEQ ID NO: 43137 - DNA, 20 bp, Homo sapiens
agtgtttggaattgaactcg

SEQ ID NO: 43138 - DNA, 26 bp, Homo sapiens
tattttgagtgtttggaattgaactc

SEQ ID NO: 43139 - DNA, 22 bp, Homo sapiens
tttgagtgtttggaattgaact

SEQ ID NO: 43140 - DNA, 27 bp, Homo sapiens
agatattttgagtgtttggaattgaac

SEQ ID NO: 43141 - DNA, 23 bp, Homo sapiens
tattttgagtgtttggaattgaa

SEQ ID NO: 43142 - DNA, 21 bp, Homo sapiens
attttgagtgtttggaattga

SEQ ID NO: 43143 - DNA, 22 bp, Homo sapiens
tattttgagtgtttggaattga

SEQ ID NO: 43144 - DNA, 25 bp, Homo sapiens
agatattttgagtgtttggaattga

SEQ ID NO: 43145 - DNA, 21 bp, Homo sapiens
tattttgagtgtttggaattg

SEQ ID NO: 43146 - DNA, 23 bp, Homo sapiens
agatattttgagtgtttggaatt

SEQ ID NO: 43147 - DNA, 22 bp, Homo sapiens
agatattttgagtgtttggaat

SEQ ID NO: 43148 - DNA, 21 bp, Homo sapiens
agatattttgagtgtttggaa

SEQ ID NO: 43149 - DNA, 20 bp, Homo sapiens
agatattttgagtgtttgga

SEQ ID NO: 43150 - DNA, 19 bp, Homo sapiens
agatattttgagtgtttgg

SEQ ID NO: 43151 - DNA, 23 bp, Homo sapiens
actccaaacactcaaaactcatt

SEQ ID NO: 43152 - DNA, 24 bp, Homo sapiens
aactccaaacactcaaaactcatt

SEQ ID NO: 43153 - DNA, 23 bp, Homo sapiens
aactccaaacactcaaaactcat

SEQ ID NO: 43154 - DNA, 21 bp, Homo sapiens
aactccaaacactcaaaactc

SEQ ID NO: 43155 - DNA, 20 bp, Homo sapiens
aactccaaacactcaaaact

SEQ ID NO: 43156 - DNA, 19 bp, Homo sapiens
aactccaaacactcaaaac

SEQ ID NO: 43157 - DNA, 27 bp, Homo sapiens
cgcgcctgcaggaactggtagatctcg

SEQ ID NO: 43158 - DNA, 25 bp, Homo sapiens
cgcgcctgcaggaactggtagatct

SEQ ID NO: 43159 - DNA, 24 bp, Homo sapiens
cgcgcctgcaggaactggtagatc

SEQ ID NO: 43160 - DNA, 23 bp, Homo sapiens
cgcgcctgcaggaactggtagat

SEQ ID NO: 43161 - DNA, 21 bp, Homo sapiens
cgcgcctgcaggaactggtag

SEQ ID NO: 43162 - DNA, 20 bp, Homo sapiens
cgcgcctgcaggaactggta

SEQ ID NO: 43163 - DNA, 18 bp, Homo sapiens
cgcgcctgcaggaactgg

SEQ ID NO: 43164 - DNA, 26 bp, Homo sapiens
ttccagccctggtaggcgccgcggaa

SEQ ID NO: 43165 - DNA, 25 bp, Homo sapiens
ttccagccctggtaggcgccgcgga

SEQ ID NO: 43166 - DNA, 24 bp, Homo sapiens
ttccagccctggtaggcgccgcgg

SEQ ID NO: 43167 - DNA, 22 bp, Homo sapiens
ttccagccctggtaggcgccgc

SEQ ID NO: 43168 - DNA, 21 bp, Homo sapiens
ttccagccctggtaggcgccg

SEQ ID NO: 43169 - DNA, 19 bp, Homo sapiens
ttccagccctggtaggcgc

SEQ ID NO: 43170 - DNA, 21 bp, Homo sapiens
tcaagtagtctgaccagggga

SEQ ID NO: 43171 - DNA, 20 bp, Homo sapiens
ggcgacaaaacgagaccctg

SEQ ID NO: 43172 - DNA, 21 bp, Homo sapiens
ggcgacaaaacgagaccctgt

SEQ ID NO: 43173 - DNA, 24 bp, Homo sapiens
ggcgacaaaacgagaccctgtctt

SEQ ID NO: 43174 - DNA, 25 bp, Homo sapiens
ggcgacaaaacgagaccctgtcttt

SEQ ID NO: 43175 - DNA, 26 bp, Homo sapiens
ggcgacaaaacgagaccctgtctttt

SEQ ID NO: 43176 - DNA, 23 bp, Homo sapiens
gcgacaaaacgagaccctgtctt

SEQ ID NO: 43177 - DNA, 22 bp, Homo sapiens
cgacaaaacgagaccctgtctt

SEQ ID NO: 43178 - DNA, 23 bp, Homo sapiens
cgacaaaacgagaccctgtcttt

SEQ ID NO: 43179 - DNA, 25 bp, Homo sapiens
cgacaaaacgagaccctgtcttttt

SEQ ID NO: 43180 - DNA, 16 bp, Homo sapiens
gccggcggggtagaag

SEQ ID NO: 43181 - DNA, 24 bp, Homo sapiens
gggtgcgggccggcggggtagaag

SEQ ID NO: 43182 - DNA, 22 bp, Homo sapiens
ggtgcgggccggcggggtagaa

SEQ ID NO: 43183 - DNA, 23 bp, Homo sapiens
gggtgcgggccggcggggtagaa

SEQ ID NO: 43184 - DNA, 22 bp, Homo sapiens
gggtgcgggccggcggggtaga

SEQ ID NO: 43185 - DNA, 21 bp, Homo sapiens
gggtgcgggccggcggggtag

SEQ ID NO: 43186 - DNA, 20 bp, Homo sapiens
gggtgcgggccggcggggta

SEQ ID NO: 43187 - DNA, 18 bp, Homo sapiens
ggtgcgggccggcggggt

SEQ ID NO: 43188 - DNA, 19 bp, Homo sapiens
gggtgcgggccggcggggt

SEQ ID NO: 43189 - DNA, 22 bp, Homo sapiens
cgcgggtgcgggccggcggggt

SEQ ID NO: 43190 - DNA, 23 bp, Homo sapiens
acgcgggtgcgggccggcggggt

SEQ ID NO: 43191 - DNA, 20 bp, Homo sapiens
gcgggtgcgggccggcgggg

SEQ ID NO: 43192 - DNA, 21 bp, Homo sapiens
acgcgggtgcgggccggcggg

SEQ ID NO: 43193 - DNA, 17 bp, Homo sapiens
cgcgggtgcgggccggc

SEQ ID NO: 43194 - DNA, 20 bp, Homo sapiens
cctgctggtcaggagtggat

SEQ ID NO: 43195 - DNA, 21 bp, Homo sapiens
cctgctggtcaggagtggata

SEQ ID NO: 43196 - DNA, 22 bp, Homo sapiens
cctgctggtcaggagtggatac

SEQ ID NO: 43197 - DNA, 25 bp, Homo sapiens
cctgctggtcaggagtggatactgg

SEQ ID NO: 43198 - DNA, 18 bp, Homo sapiens
gttccacactgacactgc

SEQ ID NO: 43199 - DNA, 20 bp, Homo sapiens
gttccacactgacactgcag

SEQ ID NO: 43200 - DNA, 21 bp, Homo sapiens
gttccacactgacactgcaga

SEQ ID NO: 43201 - DNA, 22 bp, Homo sapiens
gttccacactgacactgcagaa

SEQ ID NO: 43202 - DNA, 23 bp, Homo sapiens
gttccacactgacactgcagaag

SEQ ID NO: 43203 - DNA, 22 bp, Homo sapiens
ttccacactgacactgcagaag

SEQ ID NO: 43204 - DNA, 23 bp, Homo sapiens
ttccacactgacactgcagaagt

SEQ ID NO: 43205 - DNA, 25 bp, Homo sapiens
tctgcttaaagactgtagaggcaac

SEQ ID NO: 43206 - DNA, 24 bp, Homo sapiens
ctgcttaaagactgtagaggcaac

SEQ ID NO: 43207 - DNA, 25 bp, Homo sapiens
agactgtagaggcaactggtgttct

SEQ ID NO: 43208 - DNA, 18 bp, Homo sapiens
gagactagatctttgact

SEQ ID NO: 43209 - DNA, 22 bp, Homo sapiens
ttgactctggcagtctccagga

SEQ ID NO: 43210 - DNA, 24 bp, Homo sapiens
ttgactctggcagtctccaggact

SEQ ID NO: 43211 - DNA, 21 bp, Homo sapiens
ctggcagtctccaggactgta

SEQ ID NO: 43212 - DNA, 17 bp, Homo sapiens
tggcagtctccaggact

SEQ ID NO: 43213 - DNA, 23 bp, Homo sapiens
acagggccgcagatggagactgc

SEQ ID NO: 43214 - DNA, 22 bp, Homo sapiens
gacagggccgcagatggagact

SEQ ID NO: 43215 - DNA, 18 bp, Homo sapiens
agggccgcagatggagac

SEQ ID NO: 43216 - DNA, 20 bp, Homo sapiens
acagggccgcagatggagac

SEQ ID NO: 43217 - DNA, 21 bp, Homo sapiens
gacagggccgcagatggagac

SEQ ID NO: 43218 - DNA, 19 bp, Homo sapiens
acagggccgcagatggaga

SEQ ID NO: 43219 - DNA, 20 bp, Homo sapiens
gacagggccgcagatggaga

SEQ ID NO: 43220 - DNA, 19 bp, Homo sapiens
gacagggccgcagatggag

SEQ ID NO: 43221 - DNA, 21 bp, Homo sapiens
catgggacagggccgcagatg

SEQ ID NO: 43222 - DNA, 21 bp, Homo sapiens
attgctaagtaggctgagatt

SEQ ID NO: 43223 - DNA, 22 bp, Homo sapiens
attgctaagtaggctgagattg

SEQ ID NO: 43224 - DNA, 21 bp, Homo sapiens
ttgctaagtaggctgagattg

SEQ ID NO: 43225 - DNA, 24 bp, Homo sapiens
ttgctaagtaggctgagattgatg

SEQ ID NO: 43226 - DNA, 21 bp, Homo sapiens
tgctaagtaggctgagattga

SEQ ID NO: 43227 - DNA, 22 bp, Homo sapiens
tgctaagtaggctgagattgat

SEQ ID NO: 43228 - DNA, 23 bp, Homo sapiens
tgctaagtaggctgagattgatg

SEQ ID NO: 43229 - DNA, 24 bp, Homo sapiens
tgctaagtaggctgagattgatgt

SEQ ID NO: 43230 - DNA, 26 bp, Homo sapiens
tgctaagtaggctgagattgatgtca

SEQ ID NO: 43231 - DNA, 21 bp, Homo sapiens
taagtaggctgagattgatgt

SEQ ID NO: 43232 - DNA, 23 bp, Homo sapiens
taagtaggctgagattgatgtca

SEQ ID NO: 43233 - DNA, 28 bp, Homo sapiens
ataacctcactctcaccttgctttgcag

SEQ ID NO: 43234 - DNA, 22 bp, Homo sapiens
cctcactctcaccttgctttgc

SEQ ID NO: 43235 - DNA, 22 bp, Homo sapiens
ctcactctcaccttgctttgca

SEQ ID NO: 43236 - DNA, 24 bp, Homo sapiens
ctcactctcaccttgctttgcagg

SEQ ID NO: 43237 - DNA, 21 bp, Homo sapiens
tcactctcaccttgctttgca

SEQ ID NO: 43238 - DNA, 22 bp, Homo sapiens
tcactctcaccttgctttgcag

SEQ ID NO: 43239 - DNA, 23 bp, Homo sapiens
tcactctcaccttgctttgcagg

SEQ ID NO: 43240 - DNA, 22 bp, Homo sapiens
cactctcaccttgctttgcagg

SEQ ID NO: 43241 - DNA, 19 bp, Homo sapiens
actctcaccttgctttgca

SEQ ID NO: 43242 - DNA, 21 bp, Homo sapiens
actctcaccttgctttgcagg

SEQ ID NO: 43243 - DNA, 22 bp, Homo sapiens
actctcaccttgctttgcaggc

SEQ ID NO: 43244 - DNA, 23 bp, Homo sapiens
actctcaccttgctttgcaggca

SEQ ID NO: 43245 - DNA, 25 bp, Homo sapiens
tctgccccctccgctgctgccaagt

SEQ ID NO: 43246 - DNA, 24 bp, Homo sapiens
tctgccccctccgctgctgccaag

SEQ ID NO: 43247 - DNA, 22 bp, Homo sapiens
ctgccccctccgctgctgccaa

SEQ ID NO: 43248 - DNA, 23 bp, Homo sapiens
tctgccccctccgctgctgccaa

SEQ ID NO: 43249 - DNA, 21 bp, Homo sapiens
tctgccccctccgctgctgcc

SEQ ID NO: 43250 - DNA, 20 bp, Homo sapiens
tctgccccctccgctgctgc

SEQ ID NO: 43251 - DNA, 19 bp, Homo sapiens
tctgccccctccgctgctg

SEQ ID NO: 43252 - DNA, 16 bp, Homo sapiens
caaaactctgccccct

SEQ ID NO: 43253 - DNA, 23 bp, Homo sapiens
tacgcgcagaccacaggatgtcc

SEQ ID NO: 43254 - DNA, 21 bp, Homo sapiens
tacgcgcagaccacaggatgt

SEQ ID NO: 43255 - DNA, 23 bp, Homo sapiens
tgtacgcgcagaccacaggatgt

SEQ ID NO: 43256 - DNA, 20 bp, Homo sapiens
tacgcgcagaccacaggatg

SEQ ID NO: 43257 - DNA, 19 bp, Homo sapiens
tacgcgcagaccacaggat

SEQ ID NO: 43258 - DNA, 18 bp, Homo sapiens
tacgcgcagaccacagga

SEQ ID NO: 43259 - DNA, 22 bp, Homo sapiens
gtggagagagaaaagagacaga

SEQ ID NO: 43260 - DNA, 21 bp, Homo sapiens
tggagagagaaaagagacaga

SEQ ID NO: 43261 - DNA, 24 bp, Homo sapiens
tggagagagaaaagagacagaagg

SEQ ID NO: 43262 - DNA, 27 bp, Homo sapiens
tggagagagaaaagagacagaaggatg

SEQ ID NO: 43263 - DNA, 23 bp, Homo sapiens
ggagagagaaaagagacagaagg

SEQ ID NO: 43264 - DNA, 18 bp, Homo sapiens
aagagacagaaggatggc

SEQ ID NO: 43265 - DNA, 24 bp, Homo sapiens
acaaaactggcaattacttttgca

SEQ ID NO: 43266 - DNA, 21 bp, Homo sapiens
ctggcaattacttttgcacca

SEQ ID NO: 43267 - DNA, 16 bp, Homo sapiens
cgctagataacattgt

SEQ ID NO: 43268 - DNA, 20 bp, Homo sapiens
cgctagataacattgtaaag

SEQ ID NO: 43269 - DNA, 20 bp, Homo sapiens
gctagataacattgtaaagc

SEQ ID NO: 43270 - DNA, 21 bp, Homo sapiens
gctagataacattgtaaagcg

SEQ ID NO: 43271 - DNA, 22 bp, Homo sapiens
gctagataacattgtaaagcgc

SEQ ID NO: 43272 - DNA, 23 bp, Homo sapiens
gctagataacattgtaaagcgct

SEQ ID NO: 43273 - DNA, 24 bp, Homo sapiens
gctagataacattgtaaagcgctt

SEQ ID NO: 43274 - DNA, 23 bp, Homo sapiens
agataacattgtaaagcgcttct

SEQ ID NO: 43275 - DNA, 19 bp, Homo sapiens
gataacattgtaaagcgct

SEQ ID NO: 43276 - DNA, 22 bp, Homo sapiens
gataacattgtaaagcgcttct

SEQ ID NO: 43277 - DNA, 23 bp, Homo sapiens
gataacattgtaaagcgcttctt

SEQ ID NO: 43278 - DNA, 24 bp, Homo sapiens
gataacattgtaaagcgcttcttt

SEQ ID NO: 43279 - DNA, 25 bp, Homo sapiens
gataacattgtaaagcgcttctttc

SEQ ID NO: 43280 - DNA, 16 bp, Homo sapiens
ataacattgtaaagcg

SEQ ID NO: 43281 - DNA, 19 bp, Homo sapiens
ataacattgtaaagcgctt

SEQ ID NO: 43282 - DNA, 20 bp, Homo sapiens
ataacattgtaaagcgcttc

SEQ ID NO: 43283 - DNA, 21 bp, Homo sapiens
ataacattgtaaagcgcttct

SEQ ID NO: 43284 - DNA, 22 bp, Homo sapiens
ataacattgtaaagcgcttctt

SEQ ID NO: 43285 - DNA, 23 bp, Homo sapiens
ataacattgtaaagcgcttcttt

SEQ ID NO: 43286 - DNA, 24 bp, Homo sapiens
ataacattgtaaagcgcttctttc

SEQ ID NO: 43287 - DNA, 27 bp, Homo sapiens
ataacattgtaaagcgcttctttcgcg

SEQ ID NO: 43288 - DNA, 23 bp, Homo sapiens
taacattgtaaagcgcttctttc

SEQ ID NO: 43289 - DNA, 16 bp, Homo sapiens
ttgcctggtttctcta

SEQ ID NO: 43290 - DNA, 21 bp, Homo sapiens
agttcttgcctggtttctcta

SEQ ID NO: 43291 - DNA, 22 bp, Homo sapiens
gtagttcttgcctggtttctct

SEQ ID NO: 43292 - DNA, 25 bp, Homo sapiens
gacagtagttcttgcctggtttctc

SEQ ID NO: 43293 - DNA, 26 bp, Homo sapiens
agacagtagttcttgcctggtttctc

SEQ ID NO: 43294 - DNA, 23 bp, Homo sapiens
acagtagttcttgcctggtttct

SEQ ID NO: 43295 - DNA, 24 bp, Homo sapiens
agacagtagttcttgcctggtttc

SEQ ID NO: 43296 - DNA, 25 bp, Homo sapiens
gagacagtagttcttgcctggtttc

SEQ ID NO: 43297 - DNA, 26 bp, Homo sapiens
cgagacagtagttcttgcctggtttc

SEQ ID NO: 43298 - DNA, 22 bp, Homo sapiens
gacagtagttcttgcctggttt

SEQ ID NO: 43299 - DNA, 23 bp, Homo sapiens
agacagtagttcttgcctggttt

SEQ ID NO: 43300 - DNA, 25 bp, Homo sapiens
cgagacagtagttcttgcctggttt

SEQ ID NO: 43301 - DNA, 20 bp, Homo sapiens
acagtagttcttgcctggtt

SEQ ID NO: 43302 - DNA, 21 bp, Homo sapiens
gacagtagttcttgcctggtt

SEQ ID NO: 43303 - DNA, 24 bp, Homo sapiens
cgagacagtagttcttgcctggtt

SEQ ID NO: 43304 - DNA, 21 bp, Homo sapiens
agacagtagttcttgcctggt

SEQ ID NO: 43305 - DNA, 22 bp, Homo sapiens
gagacagtagttcttgcctggt

SEQ ID NO: 43306 - DNA, 23 bp, Homo sapiens
cgagacagtagttcttgcctggt

SEQ ID NO: 43307 - DNA, 20 bp, Homo sapiens
agacagtagttcttgcctgg

SEQ ID NO: 43308 - DNA, 22 bp, Homo sapiens
cgagacagtagttcttgcctgg

SEQ ID NO: 43309 - DNA, 17 bp, Homo sapiens
acagtagttcttgcctg

SEQ ID NO: 43310 - DNA, 19 bp, Homo sapiens
gagacagtagttcttgcct

SEQ ID NO: 43311 - DNA, 19 bp, Homo sapiens
cgagacagtagttcttgcc

SEQ ID NO: 43312 - DNA, 22 bp, Homo sapiens
gcgacgagacagtagttcttgc

SEQ ID NO: 43313 - DNA, 16 bp, Homo sapiens
cgagacagtagttctt

SEQ ID NO: 43314 - DNA, 25 bp, Homo sapiens
accaggcaagaaatattgtctcctc

SEQ ID NO: 43315 - DNA, 22 bp, Homo sapiens
ccaggcaagaaatattgtctcc

SEQ ID NO: 43316 - DNA, 23 bp, Homo sapiens
accaggcaagaaatattgtctcc

SEQ ID NO: 43317 - DNA, 22 bp, Homo sapiens
accaggcaagaaatattgtctc

SEQ ID NO: 43318 - DNA, 21 bp, Homo sapiens
accaggcaagaaatattgtct

SEQ ID NO: 43319 - DNA, 20 bp, Homo sapiens
accaggcaagaaatattgtc

SEQ ID NO: 43320 - DNA, 21 bp, Homo sapiens
aaccaggcaagaaatattgtc

SEQ ID NO: 43321 - DNA, 23 bp, Homo sapiens
gaaaccaggcaagaaatattgtc

SEQ ID NO: 43322 - DNA, 20 bp, Homo sapiens
aaccaggcaagaaatattgt

SEQ ID NO: 43323 - DNA, 21 bp, Homo sapiens
aaaccaggcaagaaatattgt

SEQ ID NO: 43324 - DNA, 18 bp, Homo sapiens
accaggcaagaaatattg

SEQ ID NO: 43325 - DNA, 20 bp, Homo sapiens
aaaccaggcaagaaatattg

SEQ ID NO: 43326 - DNA, 16 bp, Homo sapiens
gtagaggagatggcgc

SEQ ID NO: 43327 - DNA, 17 bp, Homo sapiens
gtagaggagatggcgca

SEQ ID NO: 43328 - DNA, 18 bp, Homo sapiens
gtagaggagatggcgcag

SEQ ID NO: 43329 - DNA, 19 bp, Homo sapiens
gtagaggagatggcgcagg

SEQ ID NO: 43330 - DNA, 21 bp, Homo sapiens
gtagaggagatggcgcagggg

SEQ ID NO: 43331 - DNA, 22 bp, Homo sapiens
gtagaggagatggcgcagggga

SEQ ID NO: 43332 - DNA, 23 bp, Homo sapiens
gtagaggagatggcgcaggggac

SEQ ID NO: 43333 - DNA, 24 bp, Homo sapiens
gtagaggagatggcgcaggggaca

SEQ ID NO: 43334 - DNA, 25 bp, Homo sapiens
gtagaggagatggcgcaggggacac

SEQ ID NO: 43335 - DNA, 26 bp, Homo sapiens
gtagaggagatggcgcaggggacacg

SEQ ID NO: 43336 - DNA, 22 bp, Homo sapiens
tagaggagatggcgcaggggac

SEQ ID NO: 43337 - DNA, 23 bp, Homo sapiens
tagaggagatggcgcaggggaca

SEQ ID NO: 43338 - DNA, 20 bp, Homo sapiens
agaggagatggcgcagggga

SEQ ID NO: 43339 - DNA, 20 bp, Homo sapiens
tgtcctcttctccctcctcc

SEQ ID NO: 43340 - DNA, 22 bp, Homo sapiens
tgtcctcttctccctcctccca

SEQ ID NO: 43341 - DNA, 23 bp, Homo sapiens
tgtcctcttctccctcctcccag

SEQ ID NO: 43342 - DNA, 21 bp, Homo sapiens
gtcctcttctccctcctccca

SEQ ID NO: 43343 - DNA, 22 bp, Homo sapiens
tcctcttctccctcctcccagg

SEQ ID NO: 43344 - DNA, 23 bp, Homo sapiens
tcctcttctccctcctcccaggt

SEQ ID NO: 43345 - DNA, 24 bp, Homo sapiens
tcctcttctccctcctcccaggtg

SEQ ID NO: 43346 - DNA, 21 bp, Homo sapiens
cctcttctccctcctcccagg

SEQ ID NO: 43347 - DNA, 23 bp, Homo sapiens
ctgggccagggagcagctggtgg

SEQ ID NO: 43348 - DNA, 24 bp, Homo sapiens
ctgggccagggagcagctggtggg

SEQ ID NO: 43349 - DNA, 26 bp, Homo sapiens
ctgggccagggagcagctggtgggtg

SEQ ID NO: 43350 - DNA, 27 bp, Homo sapiens
ctgggccagggagcagctggtgggtgg

SEQ ID NO: 43351 - DNA, 21 bp, Homo sapiens
tgggccagggagcagctggtg

SEQ ID NO: 43352 - DNA, 22 bp, Homo sapiens
tgggccagggagcagctggtgg

SEQ ID NO: 43353 - DNA, 24 bp, Homo sapiens
tgggccagggagcagctggtgggt

SEQ ID NO: 43354 - DNA, 25 bp, Homo sapiens
tgggccagggagcagctggtgggtg

SEQ ID NO: 43355 - DNA, 26 bp, Homo sapiens
tgggccagggagcagctggtgggtgg

SEQ ID NO: 43356 - DNA, 21 bp, Homo sapiens
gggccagggagcagctggtgg

SEQ ID NO: 43357 - DNA, 22 bp, Homo sapiens
gggccagggagcagctggtggg

SEQ ID NO: 43358 - DNA, 20 bp, Homo sapiens
ggccagggagcagctggtgg

SEQ ID NO: 43359 - DNA, 27 bp, Homo sapiens
ggccagggagcagctggtgggtgggaa

SEQ ID NO: 43360 - DNA, 25 bp, Homo sapiens
ccagggagcagctggtgggtgggaa

SEQ ID NO: 43361 - DNA, 18 bp, Homo sapiens
cacccaccccctgtttcc

SEQ ID NO: 43362 - DNA, 23 bp, Homo sapiens
cacccaccccctgtttcctggcc

SEQ ID NO: 43363 - DNA, 23 bp, Homo sapiens
acccaccccctgtttcctggccc

SEQ ID NO: 43364 - DNA, 22 bp, Homo sapiens
cccaccccctgtttcctggccc

SEQ ID NO: 43365 - DNA, 23 bp, Homo sapiens
cccaccccctgtttcctggccca

SEQ ID NO: 43366 - DNA, 24 bp, Homo sapiens
cccaccccctgtttcctggcccac

SEQ ID NO: 43367 - DNA, 25 bp, Homo sapiens
cccaccccctgtttcctggcccaca

SEQ ID NO: 43368 - DNA, 22 bp, Homo sapiens
ccaccccctgtttcctggccca

SEQ ID NO: 43369 - DNA, 24 bp, Homo sapiens
ccaccccctgtttcctggcccaca

SEQ ID NO: 43370 - DNA, 25 bp, Homo sapiens
ccaccccctgtttcctggcccacag

SEQ ID NO: 43371 - DNA, 17 bp, Homo sapiens
caccccctgtttcctgg

SEQ ID NO: 43372 - DNA, 19 bp, Homo sapiens
caccccctgtttcctggcc

SEQ ID NO: 43373 - DNA, 21 bp, Homo sapiens
caccccctgtttcctggccca

SEQ ID NO: 43374 - DNA, 23 bp, Homo sapiens
caccccctgtttcctggcccaca

SEQ ID NO: 43375 - DNA, 24 bp, Homo sapiens
caccccctgtttcctggcccacag

SEQ ID NO: 43376 - DNA, 25 bp, Homo sapiens
caccccctgtttcctggcccacagg

SEQ ID NO: 43377 - DNA, 22 bp, Homo sapiens
accccctgtttcctggcccaca

SEQ ID NO: 43378 - DNA, 23 bp, Homo sapiens
accccctgtttcctggcccacag

SEQ ID NO: 43379 - DNA, 23 bp, Homo sapiens
ccccctgtttcctggcccacagg

SEQ ID NO: 43380 - DNA, 22 bp, Homo sapiens
cccctgtttcctggcccacagg

SEQ ID NO: 43381 - DNA, 25 bp, Homo sapiens
ccctcatcttcccctcctttcccag

SEQ ID NO: 43382 - DNA, 23 bp, Homo sapiens
cctcatcttcccctcctttccca

SEQ ID NO: 43383 - DNA, 23 bp, Homo sapiens
ccctcatcttcccctcctttccc

SEQ ID NO: 43384 - DNA, 26 bp, Homo sapiens
ggcccctcatcttcccctcctttccc

SEQ ID NO: 43385 - DNA, 21 bp, Homo sapiens
cctcatcttcccctcctttcc

SEQ ID NO: 43386 - DNA, 22 bp, Homo sapiens
ccctcatcttcccctcctttcc

SEQ ID NO: 43387 - DNA, 20 bp, Homo sapiens
cctcatcttcccctcctttc

SEQ ID NO: 43388 - DNA, 22 bp, Homo sapiens
cccctcatcttcccctcctttc

SEQ ID NO: 43389 - DNA, 25 bp, Homo sapiens
gggcccctcatcttcccctcctttc

SEQ ID NO: 43390 - DNA, 20 bp, Homo sapiens
ccctcatcttcccctccttt

SEQ ID NO: 43391 - DNA, 21 bp, Homo sapiens
cccctcatcttcccctccttt

SEQ ID NO: 43392 - DNA, 26 bp, Homo sapiens
cagggcccctcatcttcccctccttt

SEQ ID NO: 43393 - DNA, 25 bp, Homo sapiens
cagggcccctcatcttcccctcctt

SEQ ID NO: 43394 - DNA, 24 bp, Homo sapiens
cagggcccctcatcttcccctcct

SEQ ID NO: 43395 - DNA, 23 bp, Homo sapiens
cagggcccctcatcttcccctcc

SEQ ID NO: 43396 - DNA, 21 bp, Homo sapiens
cagggcccctcatcttcccct

SEQ ID NO: 43397 - DNA, 16 bp, Homo sapiens
ggatgaggggtcatat

SEQ ID NO: 43398 - DNA, 25 bp, Homo sapiens
taaggagggggatgaggggtcatat

SEQ ID NO: 43399 - DNA, 26 bp, Homo sapiens
gtaaggagggggatgaggggtcatat

SEQ ID NO: 43400 - DNA, 25 bp, Homo sapiens
gtaaggagggggatgaggggtcata

SEQ ID NO: 43401 - DNA, 23 bp, Homo sapiens
taaggagggggatgaggggtcat

SEQ ID NO: 43402 - DNA, 24 bp, Homo sapiens
gtaaggagggggatgaggggtcat

SEQ ID NO: 43403 - DNA, 22 bp, Homo sapiens
taaggagggggatgaggggtca

SEQ ID NO: 43404 - DNA, 23 bp, Homo sapiens
gtaaggagggggatgaggggtca

SEQ ID NO: 43405 - DNA, 21 bp, Homo sapiens
taaggagggggatgaggggtc

SEQ ID NO: 43406 - DNA, 22 bp, Homo sapiens
gtaaggagggggatgaggggtc

SEQ ID NO: 43407 - DNA, 20 bp, Homo sapiens
taaggagggggatgaggggt

SEQ ID NO: 43408 - DNA, 21 bp, Homo sapiens
gtaaggagggggatgaggggt

SEQ ID NO: 43409 - DNA, 20 bp, Homo sapiens
gtaaggagggggatgagggg

SEQ ID NO: 43410 - DNA, 19 bp, Homo sapiens
gtaaggagggggatgaggg

SEQ ID NO: 43411 - DNA, 18 bp, Homo sapiens
aggtggagtagagaggaa

SEQ ID NO: 43412 - DNA, 23 bp, Homo sapiens
gtggagtagagaggaaaagttag

SEQ ID NO: 43413 - DNA, 22 bp, Homo sapiens
tggagtagagaggaaaagttag

SEQ ID NO: 43414 - DNA, 23 bp, Homo sapiens
tggagtagagaggaaaagttagg

SEQ ID NO: 43415 - DNA, 24 bp, Homo sapiens
tggagtagagaggaaaagttaggg

SEQ ID NO: 43416 - DNA, 25 bp, Homo sapiens
tggagtagagaggaaaagttagggt

SEQ ID NO: 43417 - DNA, 26 bp, Homo sapiens
tggagtagagaggaaaagttagggtc

SEQ ID NO: 43418 - DNA, 27 bp, Homo sapiens
tggagtagagaggaaaagttagggtca

SEQ ID NO: 43419 - DNA, 26 bp, Homo sapiens
ggagtagagaggaaaagttagggtca

SEQ ID NO: 43420 - DNA, 21 bp, Homo sapiens
gagtagagaggaaaagttagg

SEQ ID NO: 43421 - DNA, 25 bp, Homo sapiens
gagtagagaggaaaagttagggtca

SEQ ID NO: 43422 - DNA, 19 bp, Homo sapiens
agtagagaggaaaagttag

SEQ ID NO: 43423 - DNA, 22 bp, Homo sapiens
agtagagaggaaaagttagggt

SEQ ID NO: 43424 - DNA, 24 bp, Homo sapiens
agtagagaggaaaagttagggtca

SEQ ID NO: 43425 - DNA, 26 bp, Homo sapiens
agtagagaggaaaagttagggtcagt

SEQ ID NO: 43426 - DNA, 24 bp, Homo sapiens
tagagaggaaaagttagggtcagt

SEQ ID NO: 43427 - DNA, 27 bp, Homo sapiens
tagagaggaaaagttagggtcagtggc

SEQ ID NO: 43428 - DNA, 23 bp, Homo sapiens
agagaggaaaagttagggtcagt

SEQ ID NO: 43429 - DNA, 21 bp, Homo sapiens
atgctgaccctttttctcttt

SEQ ID NO: 43430 - DNA, 26 bp, Homo sapiens
atgctgaccctttttctctttcccag

SEQ ID NO: 43431 - DNA, 26 bp, Homo sapiens
tgctgaccctttttctctttcccaga

SEQ ID NO: 43432 - DNA, 19 bp, Homo sapiens
tgaccctttttctctttcc

SEQ ID NO: 43433 - DNA, 20 bp, Homo sapiens
tgaccctttttctctttccc

SEQ ID NO: 43434 - DNA, 21 bp, Homo sapiens
tgaccctttttctctttccca

SEQ ID NO: 43435 - DNA, 22 bp, Homo sapiens
tgaccctttttctctttcccag

SEQ ID NO: 43436 - DNA, 23 bp, Homo sapiens
tgaccctttttctctttcccaga

SEQ ID NO: 43437 - DNA, 24 bp, Homo sapiens
tgaccctttttctctttcccagac

SEQ ID NO: 43438 - DNA, 22 bp, Homo sapiens
gaccctttttctctttcccaga

SEQ ID NO: 43439 - DNA, 21 bp, Homo sapiens
accctttttctctttcccaga

SEQ ID NO: 43440 - DNA, 22 bp, Homo sapiens
accctttttctctttcccagac

SEQ ID NO: 43441 - DNA, 23 bp, Homo sapiens
accctttttctctttcccagacc

SEQ ID NO: 43442 - DNA, 25 bp, Homo sapiens
attgtccctctcccttcccaggtta

SEQ ID NO: 43443 - DNA, 22 bp, Homo sapiens
tgtccctctcccttcccaggtt

SEQ ID NO: 43444 - DNA, 23 bp, Homo sapiens
ttgtccctctcccttcccaggtt

SEQ ID NO: 43445 - DNA, 24 bp, Homo sapiens
attgtccctctcccttcccaggtt

SEQ ID NO: 43446 - DNA, 21 bp, Homo sapiens
tgtccctctcccttcccaggt

SEQ ID NO: 43447 - DNA, 22 bp, Homo sapiens
ttgtccctctcccttcccaggt

SEQ ID NO: 43448 - DNA, 23 bp, Homo sapiens
attgtccctctcccttcccaggt

SEQ ID NO: 43449 - DNA, 21 bp, Homo sapiens
ttgtccctctcccttcccagg

SEQ ID NO: 43450 - DNA, 22 bp, Homo sapiens
attgtccctctcccttcccagg

SEQ ID NO: 43451 - DNA, 23 bp, Homo sapiens
cattgtccctctcccttcccagg

SEQ ID NO: 43452 - DNA, 22 bp, Homo sapiens
cattgtccctctcccttcccag

SEQ ID NO: 43453 - DNA, 19 bp, Homo sapiens
ttgtccctctcccttccca

SEQ ID NO: 43454 - DNA, 19 bp, Homo sapiens
aggagctgagggacattgc

SEQ ID NO: 43455 - DNA, 20 bp, Homo sapiens
gaggagctgagggacattgc

SEQ ID NO: 43456 - DNA, 21 bp, Homo sapiens
agaggagctgagggacattgc

SEQ ID NO: 43457 - DNA, 22 bp, Homo sapiens
aagaggagctgagggacattgc

SEQ ID NO: 43458 - DNA, 25 bp, Homo sapiens
tgggaagaggagctgagggacattg

SEQ ID NO: 43459 - DNA, 26 bp, Homo sapiens
ctgggaagaggagctgagggacattg

SEQ ID NO: 43460 - DNA, 24 bp, Homo sapiens
tgggaagaggagctgagggacatt

SEQ ID NO: 43461 - DNA, 25 bp, Homo sapiens
ctgggaagaggagctgagggacatt

SEQ ID NO: 43462 - DNA, 26 bp, Homo sapiens
actgggaagaggagctgagggacatt

SEQ ID NO: 43463 - DNA, 23 bp, Homo sapiens
tgggaagaggagctgagggacat

SEQ ID NO: 43464 - DNA, 25 bp, Homo sapiens
aactgggaagaggagctgagggaca

SEQ ID NO: 43465 - DNA, 26 bp, Homo sapiens
gaactgggaagaggagctgagggaca

SEQ ID NO: 43466 - DNA, 21 bp, Homo sapiens
tgggaagaggagctgagggac

SEQ ID NO: 43467 - DNA, 22 bp, Homo sapiens
ctgggaagaggagctgagggac

SEQ ID NO: 43468 - DNA, 23 bp, Homo sapiens
actgggaagaggagctgagggac

SEQ ID NO: 43469 - DNA, 20 bp, Homo sapiens
tgggaagaggagctgaggga

SEQ ID NO: 43470 - DNA, 23 bp, Homo sapiens
aactgggaagaggagctgaggga

SEQ ID NO: 43471 - DNA, 18 bp, Homo sapiens
actgggaagaggagctga

SEQ ID NO: 43472 - DNA, 23 bp, Homo sapiens
tcttccccttgtctctccagcac

SEQ ID NO: 43473 - DNA, 22 bp, Homo sapiens
tcttccccttgtctctccagca

SEQ ID NO: 43474 - DNA, 23 bp, Homo sapiens
ctcttccccttgtctctccagca

SEQ ID NO: 43475 - DNA, 24 bp, Homo sapiens
cctcttccccttgtctctccagca

SEQ ID NO: 43476 - DNA, 21 bp, Homo sapiens
tcttccccttgtctctccagc

SEQ ID NO: 43477 - DNA, 22 bp, Homo sapiens
ctcttccccttgtctctccagc

SEQ ID NO: 43478 - DNA, 23 bp, Homo sapiens
cctcttccccttgtctctccagc

SEQ ID NO: 43479 - DNA, 20 bp, Homo sapiens
tcttccccttgtctctccag

SEQ ID NO: 43480 - DNA, 27 bp, Homo sapiens
taatgcctcttccccttgtctctccag

SEQ ID NO: 43481 - DNA, 20 bp, Homo sapiens
cctcttccccttgtctctcc

SEQ ID NO: 43482 - DNA, 21 bp, Homo sapiens
ataatgcctcttccccttgtc

SEQ ID NO: 43483 - DNA, 19 bp, Homo sapiens
ataatgcctcttccccttg

SEQ ID NO: 43484 - DNA, 18 bp, Homo sapiens
ataatgcctcttcccctt

SEQ ID NO: 43485 - DNA, 26 bp, Homo sapiens
agtgacaggggaaatggggatggact

SEQ ID NO: 43486 - DNA, 27 bp, Homo sapiens
gagtgacaggggaaatggggatggact

SEQ ID NO: 43487 - DNA, 27 bp, Homo sapiens
gtgagtgacaggggaaatggggatgga

SEQ ID NO: 43488 - DNA, 25 bp, Homo sapiens
tgagtgacaggggaaatggggatgg

SEQ ID NO: 43489 - DNA, 25 bp, Homo sapiens
gtgagtgacaggggaaatggggatg

SEQ ID NO: 43490 - DNA, 23 bp, Homo sapiens
tgagtgacaggggaaatggggat

SEQ ID NO: 43491 - DNA, 24 bp, Homo sapiens
gtgagtgacaggggaaatggggat

SEQ ID NO: 43492 - DNA, 23 bp, Homo sapiens
gtgagtgacaggggaaatgggga

SEQ ID NO: 43493 - DNA, 21 bp, Homo sapiens
tgagtgacaggggaaatgggg

SEQ ID NO: 43494 - DNA, 22 bp, Homo sapiens
gtgagtgacaggggaaatgggg

SEQ ID NO: 43495 - DNA, 20 bp, Homo sapiens
tgagtgacaggggaaatggg

SEQ ID NO: 43496 - DNA, 21 bp, Homo sapiens
gtgagtgacaggggaaatggg

SEQ ID NO: 43497 - DNA, 20 bp, Homo sapiens
gtgagtgacaggggaaatgg

SEQ ID NO: 43498 - DNA, 17 bp, Homo sapiens
tgagtgacaggggaaat

SEQ ID NO: 43499 - DNA, 17 bp, Homo sapiens
gtgagtgacaggggaaa

SEQ ID NO: 43500 - DNA, 20 bp, Homo sapiens
gggcttattgtaggagtctc

SEQ ID NO: 43501 - DNA, 27 bp, Homo sapiens
tgggcaggggcttattgtaggagtctc

SEQ ID NO: 43502 - DNA, 26 bp, Homo sapiens
tgggcaggggcttattgtaggagtct

SEQ ID NO: 43503 - DNA, 25 bp, Homo sapiens
tgggcaggggcttattgtaggagtc

SEQ ID NO: 43504 - DNA, 26 bp, Homo sapiens
ctgggcaggggcttattgtaggagtc

SEQ ID NO: 43505 - DNA, 24 bp, Homo sapiens
tgggcaggggcttattgtaggagt

SEQ ID NO: 43506 - DNA, 22 bp, Homo sapiens
tgggcaggggcttattgtagga

SEQ ID NO: 43507 - DNA, 21 bp, Homo sapiens
tgggcaggggcttattgtagg

SEQ ID NO: 43508 - DNA, 17 bp, Homo sapiens
tgggcaggggcttattg

SEQ ID NO: 43509 - DNA, 20 bp, Homo sapiens
gtgtggaagatgggaggaga

SEQ ID NO: 43510 - DNA, 21 bp, Homo sapiens
gtgtggaagatgggaggagaa

SEQ ID NO: 43511 - DNA, 23 bp, Homo sapiens
gtgtggaagatgggaggagaaaa

SEQ ID NO: 43512 - DNA, 19 bp, Homo sapiens
tgtggaagatgggaggaga

SEQ ID NO: 43513 - DNA, 20 bp, Homo sapiens
tgtggaagatgggaggagaa

SEQ ID NO: 43514 - DNA, 21 bp, Homo sapiens
tgtggaagatgggaggagaaa

SEQ ID NO: 43515 - DNA, 22 bp, Homo sapiens
tttctctctccacttcctcaga

SEQ ID NO: 43516 - DNA, 24 bp, Homo sapiens
tttctctctccacttcctcagatt

SEQ ID NO: 43517 - DNA, 20 bp, Homo sapiens
ttctctctccacttcctcag

SEQ ID NO: 43518 - DNA, 21 bp, Homo sapiens
ttctctctccacttcctcaga

SEQ ID NO: 43519 - DNA, 23 bp, Homo sapiens
ttctctctccacttcctcagatt

SEQ ID NO: 43520 - DNA, 22 bp, Homo sapiens
tctctctccacttcctcagatt

SEQ ID NO: 43521 - DNA, 24 bp, Homo sapiens
ggctggagcgagtgcagtggtgca

SEQ ID NO: 43522 - DNA, 25 bp, Homo sapiens
cctgattgtccaaacgcaattctcg

SEQ ID NO: 43523 - DNA, 22 bp, Homo sapiens
tgattgtccaaacgcaattctc

SEQ ID NO: 43524 - DNA, 23 bp, Homo sapiens
tgattgtccaaacgcaattctcg

SEQ ID NO: 43525 - DNA, 24 bp, Homo sapiens
tgattgtccaaacgcaattctcga

SEQ ID NO: 43526 - DNA, 25 bp, Homo sapiens
tgattgtccaaacgcaattctcgag

SEQ ID NO: 43527 - DNA, 26 bp, Homo sapiens
tgattgtccaaacgcaattctcgagt

SEQ ID NO: 43528 - DNA, 27 bp, Homo sapiens
tgattgtccaaacgcaattctcgagtc

SEQ ID NO: 43529 - DNA, 21 bp, Homo sapiens
gattgtccaaacgcaattctc

SEQ ID NO: 43530 - DNA, 22 bp, Homo sapiens
gattgtccaaacgcaattctcg

SEQ ID NO: 43531 - DNA, 23 bp, Homo sapiens
gattgtccaaacgcaattctcga

SEQ ID NO: 43532 - DNA, 21 bp, Homo sapiens
attgtccaaacgcaattctcg

SEQ ID NO: 43533 - DNA, 25 bp, Homo sapiens
attgtccaaacgcaattctcgagtc

SEQ ID NO: 43534 - DNA, 20 bp, Homo sapiens
gtccaaacgcaattctcgag

SEQ ID NO: 43535 - DNA, 21 bp, Homo sapiens
cggccgagagttgagtctgga

SEQ ID NO: 43536 - DNA, 25 bp, Homo sapiens
cggccgagagttgagtctggacgtc

SEQ ID NO: 43537 - DNA, 23 bp, Homo sapiens
ccgagagttgagtctggacgtcc

SEQ ID NO: 43538 - DNA, 22 bp, Homo sapiens
cgagagttgagtctggacgtcc

SEQ ID NO: 43539 - DNA, 23 bp, Homo sapiens
gagagttgagtctggacgtcccg

SEQ ID NO: 43540 - DNA, 19 bp, Homo sapiens
agagttgagtctggacgtc

SEQ ID NO: 43541 - DNA, 20 bp, Homo sapiens
agagttgagtctggacgtcc

SEQ ID NO: 43542 - DNA, 21 bp, Homo sapiens
agagttgagtctggacgtccc

SEQ ID NO: 43543 - DNA, 23 bp, Homo sapiens
agagttgagtctggacgtcccga

SEQ ID NO: 43544 - DNA, 24 bp, Homo sapiens
agagttgagtctggacgtcccgag

SEQ ID NO: 43545 - DNA, 25 bp, Homo sapiens
agagttgagtctggacgtcccgagc

SEQ ID NO: 43546 - DNA, 26 bp, Homo sapiens
ttctctctgtctttctctctcagtca

SEQ ID NO: 43547 - DNA, 24 bp, Homo sapiens
cagagggaatacagagggcaatca

SEQ ID NO: 43548 - DNA, 23 bp, Homo sapiens
cagagggaatacagagggcaatc

SEQ ID NO: 43549 - DNA, 23 bp, Homo sapiens
gcagagggaatacagagggcaat

SEQ ID NO: 43550 - DNA, 20 bp, Homo sapiens
agagggaatacagagggcaa

SEQ ID NO: 43551 - DNA, 21 bp, Homo sapiens
cagagggaatacagagggcaa

SEQ ID NO: 43552 - DNA, 22 bp, Homo sapiens
gcagagggaatacagagggcaa

SEQ ID NO: 43553 - DNA, 24 bp, Homo sapiens
cagcagagggaatacagagggcaa

SEQ ID NO: 43554 - DNA, 19 bp, Homo sapiens
agagggaatacagagggca

SEQ ID NO: 43555 - DNA, 20 bp, Homo sapiens
cagagggaatacagagggca

SEQ ID NO: 43556 - DNA, 22 bp, Homo sapiens
agcagagggaatacagagggca

SEQ ID NO: 43557 - DNA, 23 bp, Homo sapiens
cagcagagggaatacagagggca

SEQ ID NO: 43558 - DNA, 21 bp, Homo sapiens
agcagagggaatacagagggc

SEQ ID NO: 43559 - DNA, 16 bp, Homo sapiens
gtgagggactgggatt

SEQ ID NO: 43560 - DNA, 17 bp, Homo sapiens
gtgagggactgggattt

SEQ ID NO: 43561 - DNA, 18 bp, Homo sapiens
gtgagggactgggatttg

SEQ ID NO: 43562 - DNA, 20 bp, Homo sapiens
gtgagggactgggatttgtg

SEQ ID NO: 43563 - DNA, 22 bp, Homo sapiens
gtgagggactgggatttgtggg

SEQ ID NO: 43564 - DNA, 23 bp, Homo sapiens
gtgagggactgggatttgtgggg

SEQ ID NO: 43565 - DNA, 25 bp, Homo sapiens
gtgagggactgggatttgtggggcg

SEQ ID NO: 43566 - DNA, 26 bp, Homo sapiens
gtgagggactgggatttgtggggcga

SEQ ID NO: 43567 - DNA, 27 bp, Homo sapiens
gtgagggactgggatttgtggggcgag

SEQ ID NO: 43568 - DNA, 20 bp, Homo sapiens
tgagggactgggatttgtgg

SEQ ID NO: 43569 - DNA, 23 bp, Homo sapiens
atcacatatgtcccatccctcca

SEQ ID NO: 43570 - DNA, 24 bp, Homo sapiens
atcacatatgtcccatccctccat

SEQ ID NO: 43571 - DNA, 26 bp, Homo sapiens
atcacatatgtcccatccctccatca

SEQ ID NO: 43572 - DNA, 21 bp, Homo sapiens
acatatgtcccatccctccat

SEQ ID NO: 43573 - DNA, 22 bp, Homo sapiens
acatatgtcccatccctccatc

SEQ ID NO: 43574 - DNA, 23 bp, Homo sapiens
acatatgtcccatccctccatca

SEQ ID NO: 43575 - DNA, 27 bp, Homo sapiens
acatatgtcccatccctccatcaggaa

SEQ ID NO: 43576 - DNA, 21 bp, Homo sapiens
catatgtcccatccctccatc

SEQ ID NO: 43577 - DNA, 24 bp, Homo sapiens
catatgtcccatccctccatcagg

SEQ ID NO: 43578 - DNA, 27 bp, Homo sapiens
catatgtcccatccctccatcaggaac

SEQ ID NO: 43579 - DNA, 19 bp, Homo sapiens
tatgtcccatccctccatc

SEQ ID NO: 43580 - DNA, 21 bp, Homo sapiens
tatgtcccatccctccatcag

SEQ ID NO: 43581 - DNA, 22 bp, Homo sapiens
tatgtcccatccctccatcagg

SEQ ID NO: 43582 - DNA, 24 bp, Homo sapiens
tatgtcccatccctccatcaggaa

SEQ ID NO: 43583 - DNA, 20 bp, Homo sapiens
tgtcccatccctccatcagg

SEQ ID NO: 43584 - DNA, 21 bp, Homo sapiens
tgaggacagggcaaattcacg

SEQ ID NO: 43585 - DNA, 23 bp, Homo sapiens
tgaggacagggcaaattcacgag

SEQ ID NO: 43586 - DNA, 24 bp, Homo sapiens
tgaggacagggcaaattcacgaga

SEQ ID NO: 43587 - DNA, 26 bp, Homo sapiens
tgaggacagggcaaattcacgagatt

SEQ ID NO: 43588 - DNA, 23 bp, Homo sapiens
cttggattttcctgggcctcagg

SEQ ID NO: 43589 - DNA, 24 bp, Homo sapiens
cttggattttcctgggcctcagga

SEQ ID NO: 43590 - DNA, 25 bp, Homo sapiens
cttggattttcctgggcctcaggac

SEQ ID NO: 43591 - DNA, 18 bp, Homo sapiens
ttggattttcctgggcct

SEQ ID NO: 43592 - DNA, 22 bp, Homo sapiens
ttggattttcctgggcctcagg

SEQ ID NO: 43593 - DNA, 23 bp, Homo sapiens
ttggattttcctgggcctcagga

SEQ ID NO: 43594 - DNA, 21 bp, Homo sapiens
cagttttcaggtgtggaaact

SEQ ID NO: 43595 - DNA, 22 bp, Homo sapiens
ttcaggtgtggaaactgaggca

SEQ ID NO: 43596 - DNA, 21 bp, Homo sapiens
tcaggtgtggaaactgaggca

SEQ ID NO: 43597 - DNA, 23 bp, Homo sapiens
tcaggtgtggaaactgaggcagg

SEQ ID NO: 43598 - DNA, 24 bp, Homo sapiens
tcaggtgtggaaactgaggcagga

SEQ ID NO: 43599 - DNA, 25 bp, Homo sapiens
tcaggtgtggaaactgaggcaggag

SEQ ID NO: 43600 - DNA, 23 bp, Homo sapiens
ttgctcaggttgcacagctggga

SEQ ID NO: 43601 - DNA, 20 bp, Homo sapiens
tgctcaggttgcacagctgg

SEQ ID NO: 43602 - DNA, 21 bp, Homo sapiens
tgctcaggttgcacagctggg

SEQ ID NO: 43603 - DNA, 23 bp, Homo sapiens
tgctcaggttgcacagctgggaa

SEQ ID NO: 43604 - DNA, 24 bp, Homo sapiens
tgctcaggttgcacagctgggaag

SEQ ID NO: 43605 - DNA, 25 bp, Homo sapiens
tgctcaggttgcacagctgggaagt

SEQ ID NO: 43606 - DNA, 22 bp, Homo sapiens
ggttgcacagctgggaagtgga

SEQ ID NO: 43607 - DNA, 23 bp, Homo sapiens
gtgggggagaggctgtcttgtgt

SEQ ID NO: 43608 - DNA, 22 bp, Homo sapiens
gtgggggagaggctgtcttgtg

SEQ ID NO: 43609 - DNA, 24 bp, Homo sapiens
gtgtgggggagaggctgtcttgtg

SEQ ID NO: 43610 - DNA, 21 bp, Homo sapiens
gtgggggagaggctgtcttgt

SEQ ID NO: 43611 - DNA, 23 bp, Homo sapiens
gtgtgggggagaggctgtcttgt

SEQ ID NO: 43612 - DNA, 20 bp, Homo sapiens
gtgggggagaggctgtcttg

SEQ ID NO: 43613 - DNA, 19 bp, Homo sapiens
gtgggggagaggctgtctt

SEQ ID NO: 43614 - DNA, 21 bp, Homo sapiens
gtgtgggggagaggctgtctt

SEQ ID NO: 43615 - DNA, 18 bp, Homo sapiens
gtgggggagaggctgtct

SEQ ID NO: 43616 - DNA, 20 bp, Homo sapiens
gtgtgggggagaggctgtct

SEQ ID NO: 43617 - DNA, 18 bp, Homo sapiens
tgtgggggagaggctgtc

SEQ ID NO: 43618 - DNA, 19 bp, Homo sapiens
gtgtgggggagaggctgtc

SEQ ID NO: 43619 - DNA, 17 bp, Homo sapiens
tgtgggggagaggctgt

SEQ ID NO: 43620 - DNA, 18 bp, Homo sapiens
gtgtgggggagaggctgt

SEQ ID NO: 43621 - DNA, 19 bp, Homo sapiens
atgagggggtagaaagtgg

SEQ ID NO: 43622 - DNA, 23 bp, Homo sapiens
atgagggggtagaaagtggctga

SEQ ID NO: 43623 - DNA, 26 bp, Homo sapiens
atgagggggtagaaagtggctgaagc

SEQ ID NO: 43624 - DNA, 22 bp, Homo sapiens
tgagggggtagaaagtggctga

SEQ ID NO: 43625 - DNA, 23 bp, Homo sapiens
tgagggggtagaaagtggctgaa

SEQ ID NO: 43626 - DNA, 25 bp, Homo sapiens
tgagggggtagaaagtggctgaagc

SEQ ID NO: 43627 - DNA, 23 bp, Homo sapiens
agggggtagaaagtggctgaagc

SEQ ID NO: 43628 - DNA, 22 bp, Homo sapiens
gtagaaagtggctgaagcgaga

SEQ ID NO: 43629 - DNA, 26 bp, Homo sapiens
gtctaaaagcacttttctgtctccca

SEQ ID NO: 43630 - DNA, 22 bp, Homo sapiens
aaaagcacttttctgtctccca

SEQ ID NO: 43631 - DNA, 24 bp, Homo sapiens
aaaagcacttttctgtctcccagc

SEQ ID NO: 43632 - DNA, 21 bp, Homo sapiens
aagcacttttctgtctcccag

SEQ ID NO: 43633 - DNA, 22 bp, Homo sapiens
aagcacttttctgtctcccagc

SEQ ID NO: 43634 - DNA, 24 bp, Homo sapiens
aagcacttttctgtctcccagcat

SEQ ID NO: 43635 - DNA, 20 bp, Homo sapiens
agcacttttctgtctcccag

SEQ ID NO: 43636 - DNA, 22 bp, Homo sapiens
cactgggggaggaaggacaggc

SEQ ID NO: 43637 - DNA, 21 bp, Homo sapiens
actgggggaggaaggacaggc

SEQ ID NO: 43638 - DNA, 23 bp, Homo sapiens
actgggggaggaaggacaggcca

SEQ ID NO: 43639 - DNA, 24 bp, Homo sapiens
actgggggaggaaggacaggccat

SEQ ID NO: 43640 - DNA, 22 bp, Homo sapiens
ctgggggaggaaggacaggcca

SEQ ID NO: 43641 - DNA, 23 bp, Homo sapiens
ctgggggaggaaggacaggccat

SEQ ID NO: 43642 - DNA, 25 bp, Homo sapiens
ctgggggaggaaggacaggccatct

SEQ ID NO: 43643 - DNA, 20 bp, Homo sapiens
tgggggaggaaggacaggcc

SEQ ID NO: 43644 - DNA, 21 bp, Homo sapiens
tgggggaggaaggacaggcca

SEQ ID NO: 43645 - DNA, 23 bp, Homo sapiens
tgggggaggaaggacaggccatc

SEQ ID NO: 43646 - DNA, 24 bp, Homo sapiens
tgggggaggaaggacaggccatct

SEQ ID NO: 43647 - DNA, 19 bp, Homo sapiens
aaggacaggccatctgcta

SEQ ID NO: 43648 - DNA, 19 bp, Homo sapiens
gacttgatcctctcttccc

SEQ ID NO: 43649 - DNA, 20 bp, Homo sapiens
gacttgatcctctcttccct

SEQ ID NO: 43650 - DNA, 21 bp, Homo sapiens
gacttgatcctctcttccctc

SEQ ID NO: 43651 - DNA, 22 bp, Homo sapiens
gacttgatcctctcttccctcc

SEQ ID NO: 43652 - DNA, 23 bp, Homo sapiens
gacttgatcctctcttccctcct

SEQ ID NO: 43653 - DNA, 22 bp, Homo sapiens
acttgatcctctcttccctcct

SEQ ID NO: 43654 - DNA, 27 bp, Homo sapiens
tgatcctctcttccctcctcccaggtg

SEQ ID NO: 43655 - DNA, 20 bp, Homo sapiens
atcctctcttccctcctccc

SEQ ID NO: 43656 - DNA, 23 bp, Homo sapiens
atcctctcttccctcctcccagg

SEQ ID NO: 43657 - DNA, 24 bp, Homo sapiens
atcctctcttccctcctcccaggt

SEQ ID NO: 43658 - DNA, 25 bp, Homo sapiens
atcctctcttccctcctcccaggtg

SEQ ID NO: 43659 - DNA, 20 bp, Homo sapiens
tcctctcttccctcctccca

SEQ ID NO: 43660 - DNA, 22 bp, Homo sapiens
tcctctcttccctcctcccagg

SEQ ID NO: 43661 - DNA, 24 bp, Homo sapiens
cagctactacctctattaggattt

SEQ ID NO: 43662 - DNA, 25 bp, Homo sapiens
tcagctactacctctattaggattt

SEQ ID NO: 43663 - DNA, 24 bp, Homo sapiens
tcagctactacctctattaggatt

SEQ ID NO: 43664 - DNA, 25 bp, Homo sapiens
ttcagctactacctctattaggatt

SEQ ID NO: 43665 - DNA, 23 bp, Homo sapiens
tcagctactacctctattaggat

SEQ ID NO: 43666 - DNA, 21 bp, Homo sapiens
cagctactacctctattagga

SEQ ID NO: 43667 - DNA, 22 bp, Homo sapiens
tcagctactacctctattagga

SEQ ID NO: 43668 - DNA, 23 bp, Homo sapiens
ttcagctactacctctattagga

SEQ ID NO: 43669 - DNA, 20 bp, Homo sapiens
tcagctactacctctattag

SEQ ID NO: 43670 - DNA, 19 bp, Homo sapiens
tcagctactacctctatta

SEQ ID NO: 43671 - DNA, 18 bp, Homo sapiens
tcagctactacctctatt

SEQ ID NO: 43672 - DNA, 23 bp, Homo sapiens
actccagttttagttctcttgct

SEQ ID NO: 43673 - DNA, 22 bp, Homo sapiens
actccagttttagttctcttgc

SEQ ID NO: 43674 - DNA, 23 bp, Homo sapiens
gactccagttttagttctcttgc

SEQ ID NO: 43675 - DNA, 20 bp, Homo sapiens
ctccagttttagttctcttg

SEQ ID NO: 43676 - DNA, 22 bp, Homo sapiens
gactccagttttagttctcttg

SEQ ID NO: 43677 - DNA, 21 bp, Homo sapiens
gactccagttttagttctctt

SEQ ID NO: 43678 - DNA, 25 bp, Homo sapiens
aagagaactgaaagtggagcctgtc

SEQ ID NO: 43679 - DNA, 22 bp, Homo sapiens
gagaactgaaagtggagcctgt

SEQ ID NO: 43680 - DNA, 23 bp, Homo sapiens
agagaactgaaagtggagcctgt

SEQ ID NO: 43681 - DNA, 22 bp, Homo sapiens
agagaactgaaagtggagcctg

SEQ ID NO: 43682 - DNA, 21 bp, Homo sapiens
aagagaactgaaagtggagcc

SEQ ID NO: 43683 - DNA, 19 bp, Homo sapiens
agagaactgaaagtggagc

SEQ ID NO: 43684 - DNA, 20 bp, Homo sapiens
aagagaactgaaagtggagc

SEQ ID NO: 43685 - DNA, 23 bp, Homo sapiens
agcaagagaactgaaagtggagc

SEQ ID NO: 43686 - DNA, 22 bp, Homo sapiens
acacggagggtggcttgggaaa

SEQ ID NO: 43687 - DNA, 24 bp, Homo sapiens
tgacacggagggtggcttgggaaa

SEQ ID NO: 43688 - DNA, 20 bp, Homo sapiens
tgcccatgccatacttttgc

SEQ ID NO: 43689 - DNA, 21 bp, Homo sapiens
tgcccatgccatacttttgcc

SEQ ID NO: 43690 - DNA, 22 bp, Homo sapiens
tgcccatgccatacttttgcct

SEQ ID NO: 43691 - DNA, 23 bp, Homo sapiens
tgcccatgccatacttttgcctc

SEQ ID NO: 43692 - DNA, 25 bp, Homo sapiens
tgcccatgccatacttttgcctcag

SEQ ID NO: 43693 - DNA, 26 bp, Homo sapiens
tgcccatgccatacttttgcctcagc

SEQ ID NO: 43694 - DNA, 17 bp, Homo sapiens
ccatgccatacttttgc

SEQ ID NO: 43695 - DNA, 23 bp, Homo sapiens
ccatgccatacttttgcctcagc

SEQ ID NO: 43696 - DNA, 22 bp, Homo sapiens
cctggggaaggcttggcaggga

SEQ ID NO: 43697 - DNA, 23 bp, Homo sapiens
cctggggaaggcttggcagggaa

SEQ ID NO: 43698 - DNA, 24 bp, Homo sapiens
cctggggaaggcttggcagggaag

SEQ ID NO: 43699 - DNA, 25 bp, Homo sapiens
cctggggaaggcttggcagggaaga

SEQ ID NO: 43700 - DNA, 26 bp, Homo sapiens
cctggggaaggcttggcagggaagac

SEQ ID NO: 43701 - DNA, 21 bp, Homo sapiens
ctggggaaggcttggcaggga

SEQ ID NO: 43702 - DNA, 23 bp, Homo sapiens
ctggggaaggcttggcagggaag

SEQ ID NO: 43703 - DNA, 25 bp, Homo sapiens
ctggggaaggcttggcagggaagac

SEQ ID NO: 43704 - DNA, 19 bp, Homo sapiens
tggggaaggcttggcaggg

SEQ ID NO: 43705 - DNA, 21 bp, Homo sapiens
tggggaaggcttggcagggaa

SEQ ID NO: 43706 - DNA, 22 bp, Homo sapiens
tggggaaggcttggcagggaag

SEQ ID NO: 43707 - DNA, 24 bp, Homo sapiens
tggggaaggcttggcagggaagac

SEQ ID NO: 43708 - DNA, 26 bp, Homo sapiens
tggggaaggcttggcagggaagacac

SEQ ID NO: 43709 - DNA, 18 bp, Homo sapiens
aaggcttggcagggaaga

SEQ ID NO: 43710 - DNA, 17 bp, Homo sapiens
tcccttgtctcctttcc

SEQ ID NO: 43711 - DNA, 20 bp, Homo sapiens
tcccttgtctcctttcccta

SEQ ID NO: 43712 - DNA, 22 bp, Homo sapiens
tcccttgtctcctttccctagc

SEQ ID NO: 43713 - DNA, 23 bp, Homo sapiens
tcccttgtctcctttccctagct

SEQ ID NO: 43714 - DNA, 24 bp, Homo sapiens
tcccttgtctcctttccctagctt

SEQ ID NO: 43715 - DNA, 21 bp, Homo sapiens
cccttgtctcctttccctagc

SEQ ID NO: 43716 - DNA, 16 bp, Homo sapiens
tgctgaggaaagggga

SEQ ID NO: 43717 - DNA, 24 bp, Homo sapiens
atggtgctgtgctgaggaaagggg

SEQ ID NO: 43718 - DNA, 25 bp, Homo sapiens
agatggtgctgtgctgaggaaaggg

SEQ ID NO: 43719 - DNA, 27 bp, Homo sapiens
gaagatggtgctgtgctgaggaaaggg

SEQ ID NO: 43720 - DNA, 23 bp, Homo sapiens
gatggtgctgtgctgaggaaagg

SEQ ID NO: 43721 - DNA, 24 bp, Homo sapiens
aagatggtgctgtgctgaggaaag

SEQ ID NO: 43722 - DNA, 25 bp, Homo sapiens
gaagatggtgctgtgctgaggaaag

SEQ ID NO: 43723 - DNA, 21 bp, Homo sapiens
gatggtgctgtgctgaggaaa

SEQ ID NO: 43724 - DNA, 23 bp, Homo sapiens
aagatggtgctgtgctgaggaaa

SEQ ID NO: 43725 - DNA, 24 bp, Homo sapiens
gaagatggtgctgtgctgaggaaa

SEQ ID NO: 43726 - DNA, 22 bp, Homo sapiens
aagatggtgctgtgctgaggaa

SEQ ID NO: 43727 - DNA, 24 bp, Homo sapiens
tgaagatggtgctgtgctgaggaa

SEQ ID NO: 43728 - DNA, 22 bp, Homo sapiens
gaagatggtgctgtgctgagga

SEQ ID NO: 43729 - DNA, 21 bp, Homo sapiens
gaagatggtgctgtgctgagg

SEQ ID NO: 43730 - DNA, 20 bp, Homo sapiens
gaagatggtgctgtgctgag

SEQ ID NO: 43731 - DNA, 19 bp, Homo sapiens
gaagatggtgctgtgctga

SEQ ID NO: 43732 - DNA, 18 bp, Homo sapiens
gaagatggtgctgtgctg

SEQ ID NO: 43733 - DNA, 16 bp, Homo sapiens
gagggtgaagatggtg

SEQ ID NO: 43734 - DNA, 18 bp, Homo sapiens
actgcatggcatcgtccc

SEQ ID NO: 43735 - DNA, 19 bp, Homo sapiens
actgcatggcatcgtcccc

SEQ ID NO: 43736 - DNA, 23 bp, Homo sapiens
tgcatggcatcgtcccctggtgg

SEQ ID NO: 43737 - DNA, 24 bp, Homo sapiens
tgcatggcatcgtcccctggtggc

SEQ ID NO: 43738 - DNA, 16 bp, Homo sapiens
catggcatcgtcccct

SEQ ID NO: 43739 - DNA, 19 bp, Homo sapiens
atggcatcgtcccctggtg

SEQ ID NO: 43740 - DNA, 20 bp, Homo sapiens
atggcatcgtcccctggtgg

SEQ ID NO: 43741 - DNA, 21 bp, Homo sapiens
atggcatcgtcccctggtggc

SEQ ID NO: 43742 - DNA, 23 bp, Homo sapiens
atggcatcgtcccctggtggctg

SEQ ID NO: 43743 - DNA, 24 bp, Homo sapiens
atggcatcgtcccctggtggctgt

SEQ ID NO: 43744 - DNA, 22 bp, Homo sapiens
atgcattgtatttttaggtccc

SEQ ID NO: 43745 - DNA, 21 bp, Homo sapiens
atgcattgtatttttaggtcc

SEQ ID NO: 43746 - DNA, 21 bp, Homo sapiens
tatgcattgtatttttaggtc

SEQ ID NO: 43747 - DNA, 22 bp, Homo sapiens
ttatgcattgtatttttaggtc

SEQ ID NO: 43748 - DNA, 20 bp, Homo sapiens
tatgcattgtatttttaggt

SEQ ID NO: 43749 - DNA, 22 bp, Homo sapiens
ccaagtctgcgtcatcctctcc

SEQ ID NO: 43750 - DNA, 23 bp, Homo sapiens
accaagtctgcgtcatcctctcc

SEQ ID NO: 43751 - DNA, 20 bp, Homo sapiens
ccaagtctgcgtcatcctct

SEQ ID NO: 43752 - DNA, 21 bp, Homo sapiens
accaagtctgcgtcatcctct

SEQ ID NO: 43753 - DNA, 22 bp, Homo sapiens
gaccaagtctgcgtcatcctct

SEQ ID NO: 43754 - DNA, 23 bp, Homo sapiens
ggaccaagtctgcgtcatcctct

SEQ ID NO: 43755 - DNA, 21 bp, Homo sapiens
ggaccaagtctgcgtcatcct

SEQ ID NO: 43756 - DNA, 20 bp, Homo sapiens
ggaccaagtctgcgtcatcc

SEQ ID NO: 43757 - DNA, 23 bp, Homo sapiens
tggggaccaagtctgcgtcatcc

SEQ ID NO: 43758 - DNA, 19 bp, Homo sapiens
ggaccaagtctgcgtcatc

SEQ ID NO: 43759 - DNA, 22 bp, Homo sapiens
tggggaccaagtctgcgtcatc

SEQ ID NO: 43760 - DNA, 21 bp, Homo sapiens
tggggaccaagtctgcgtcat

SEQ ID NO: 43761 - DNA, 17 bp, Homo sapiens
ggaccaagtctgcgtca

SEQ ID NO: 43762 - DNA, 24 bp, Homo sapiens
ggatgatggagactcggtacccac

SEQ ID NO: 43763 - DNA, 25 bp, Homo sapiens
tggatgatggagactcggtacccac

SEQ ID NO: 43764 - DNA, 26 bp, Homo sapiens
gtggatgatggagactcggtacccac

SEQ ID NO: 43765 - DNA, 27 bp, Homo sapiens
agtggatgatggagactcggtacccac

SEQ ID NO: 43766 - DNA, 24 bp, Homo sapiens
tggatgatggagactcggtaccca

SEQ ID NO: 43767 - DNA, 23 bp, Homo sapiens
tggatgatggagactcggtaccc

SEQ ID NO: 43768 - DNA, 26 bp, Homo sapiens
tagtggatgatggagactcggtaccc

SEQ ID NO: 43769 - DNA, 22 bp, Homo sapiens
tggatgatggagactcggtacc

SEQ ID NO: 43770 - DNA, 23 bp, Homo sapiens
gtggatgatggagactcggtacc

SEQ ID NO: 43771 - DNA, 24 bp, Homo sapiens
agtggatgatggagactcggtacc

SEQ ID NO: 43772 - DNA, 25 bp, Homo sapiens
tagtggatgatggagactcggtacc

SEQ ID NO: 43773 - DNA, 21 bp, Homo sapiens
tggatgatggagactcggtac

SEQ ID NO: 43774 - DNA, 22 bp, Homo sapiens
gtggatgatggagactcggtac

SEQ ID NO: 43775 - DNA, 24 bp, Homo sapiens
tagtggatgatggagactcggtac

SEQ ID NO: 43776 - DNA, 20 bp, Homo sapiens
tggatgatggagactcggta

SEQ ID NO: 43777 - DNA, 21 bp, Homo sapiens
gtggatgatggagactcggta

SEQ ID NO: 43778 - DNA, 22 bp, Homo sapiens
agtggatgatggagactcggta

SEQ ID NO: 43779 - DNA, 23 bp, Homo sapiens
tagtggatgatggagactcggta

SEQ ID NO: 43780 - DNA, 20 bp, Homo sapiens
gtggatgatggagactcggt

SEQ ID NO: 43781 - DNA, 21 bp, Homo sapiens
agtggatgatggagactcggt

SEQ ID NO: 43782 - DNA, 22 bp, Homo sapiens
tagtggatgatggagactcggt

SEQ ID NO: 43783 - DNA, 19 bp, Homo sapiens
gtggatgatggagactcgg

SEQ ID NO: 43784 - DNA, 20 bp, Homo sapiens
agtggatgatggagactcgg

SEQ ID NO: 43785 - DNA, 21 bp, Homo sapiens
tagtggatgatggagactcgg

SEQ ID NO: 43786 - DNA, 20 bp, Homo sapiens
tagtggatgatggagactcg

SEQ ID NO: 43787 - DNA, 19 bp, Homo sapiens
tggaatgtaaggaagtgtg

SEQ ID NO: 43788 - DNA, 20 bp, Homo sapiens
tggaatgtaaggaagtgtgt

SEQ ID NO: 43789 - DNA, 21 bp, Homo sapiens
tggaatgtaaggaagtgtgtg

SEQ ID NO: 43790 - DNA, 23 bp, Homo sapiens
tggaatgtaaggaagtgtgtggt

SEQ ID NO: 43791 - DNA, 24 bp, Homo sapiens
tggaatgtaaggaagtgtgtggtt

SEQ ID NO: 43792 - DNA, 26 bp, Homo sapiens
tggaatgtaaggaagtgtgtggtttc

SEQ ID NO: 43793 - DNA, 21 bp, Homo sapiens
ggaatgtaaggaagtgtgtgg

SEQ ID NO: 43794 - DNA, 24 bp, Homo sapiens
aggtttggtccccttcaaccagct

SEQ ID NO: 43795 - DNA, 22 bp, Homo sapiens
gtttggtccccttcaaccagct

SEQ ID NO: 43796 - DNA, 23 bp, Homo sapiens
tttggtccccttcaaccagctac

SEQ ID NO: 43797 - DNA, 24 bp, Homo sapiens
tttggtccccttcaaccagctaca

SEQ ID NO: 43798 - DNA, 25 bp, Homo sapiens
tttggtccccttcaaccagctacag

SEQ ID NO: 43799 - DNA, 21 bp, Homo sapiens
ttggtccccttcaaccagcta

SEQ ID NO: 43800 - DNA, 22 bp, Homo sapiens
ttggtccccttcaaccagctac

SEQ ID NO: 43801 - DNA, 23 bp, Homo sapiens
ttggtccccttcaaccagctaca

SEQ ID NO: 43802 - DNA, 21 bp, Homo sapiens
tggtccccttcaaccagctac

SEQ ID NO: 43803 - DNA, 18 bp, Homo sapiens
gtccccttcaaccagcta

SEQ ID NO: 43804 - DNA, 17 bp, Homo sapiens
tacatcacagcccagca

SEQ ID NO: 43805 - DNA, 19 bp, Homo sapiens
tcacagcccagcagttatc

SEQ ID NO: 43806 - DNA, 23 bp, Homo sapiens
acagcccagcagttatcacgggc

SEQ ID NO: 43807 - DNA, 24 bp, Homo sapiens
cagcccagcagttatcacgggccc

SEQ ID NO: 43808 - DNA, 20 bp, Homo sapiens
agcccagcagttatcacggg

SEQ ID NO: 43809 - DNA, 24 bp, Homo sapiens
caaagactgcaattacttttgcgc

SEQ ID NO: 43810 - DNA, 22 bp, Homo sapiens
aaagactgcaattacttttgcg

SEQ ID NO: 43811 - DNA, 23 bp, Homo sapiens
aaagactgcaattacttttgcgc

SEQ ID NO: 43812 - DNA, 21 bp, Homo sapiens
aagactgcaattacttttgcg

SEQ ID NO: 43813 - DNA, 22 bp, Homo sapiens
aagactgcaattacttttgcgc

SEQ ID NO: 43814 - DNA, 20 bp, Homo sapiens
tacagatgcagattctctga

SEQ ID NO: 43815 - DNA, 21 bp, Homo sapiens
tacagatgcagattctctgac

SEQ ID NO: 43816 - DNA, 22 bp, Homo sapiens
tacagatgcagattctctgact

SEQ ID NO: 43817 - DNA, 23 bp, Homo sapiens
tacagatgcagattctctgactt

SEQ ID NO: 43818 - DNA, 25 bp, Homo sapiens
tacagatgcagattctctgacttct

SEQ ID NO: 43819 - DNA, 27 bp, Homo sapiens
tacagatgcagattctctgacttctta

SEQ ID NO: 43820 - DNA, 21 bp, Homo sapiens
acagatgcagattctctgact

SEQ ID NO: 43821 - DNA, 23 bp, Homo sapiens
acagatgcagattctctgacttc

SEQ ID NO: 43822 - DNA, 19 bp, Homo sapiens
gatgcagattctctgactt

SEQ ID NO: 43823 - DNA, 23 bp, Homo sapiens
tcaaatgcagatcctgacttcac

SEQ ID NO: 43824 - DNA, 22 bp, Homo sapiens
tcaaatgcagatcctgacttca

SEQ ID NO: 43825 - DNA, 20 bp, Homo sapiens
tcaaatgcagatcctgactt

SEQ ID NO: 43826 - DNA, 19 bp, Homo sapiens
tcaaatgcagatcctgact

SEQ ID NO: 43827 - DNA, 26 bp, Homo sapiens
tgggagaaggctgtttactctttctg

SEQ ID NO: 43828 - DNA, 27 bp, Homo sapiens
ctgggagaaggctgtttactctttctg

SEQ ID NO: 43829 - DNA, 26 bp, Homo sapiens
ctgggagaaggctgtttactctttct

SEQ ID NO: 43830 - DNA, 24 bp, Homo sapiens
tgggagaaggctgtttactctttc

SEQ ID NO: 43831 - DNA, 25 bp, Homo sapiens
ctgggagaaggctgtttactctttc

SEQ ID NO: 43832 - DNA, 24 bp, Homo sapiens
ctgggagaaggctgtttactcttt

SEQ ID NO: 43833 - DNA, 22 bp, Homo sapiens
tgggagaaggctgtttactctt

SEQ ID NO: 43834 - DNA, 23 bp, Homo sapiens
ctgggagaaggctgtttactctt

SEQ ID NO: 43835 - DNA, 21 bp, Homo sapiens
tgggagaaggctgtttactct

SEQ ID NO: 43836 - DNA, 21 bp, Homo sapiens
ctgggagaaggctgtttactc

SEQ ID NO: 43837 - DNA, 20 bp, Homo sapiens
ctgggagaaggctgtttact

SEQ ID NO: 43838 - DNA, 19 bp, Homo sapiens
ctgggagaaggctgtttac

SEQ ID NO: 43839 - DNA, 28 bp, Homo sapiens
tgtaaacatcctacactctcagctgtgg

SEQ ID NO: 43840 - DNA, 27 bp, Homo sapiens
ctgtaaacatcctacactctcagctgt

SEQ ID NO: 43841 - DNA, 25 bp, Homo sapiens
tgtaaacatcctacactctcagctg

SEQ ID NO: 43842 - DNA, 26 bp, Homo sapiens
ctgtaaacatcctacactctcagctg

SEQ ID NO: 43843 - DNA, 23 bp, Homo sapiens
gtaaacatcctacactctcagct

SEQ ID NO: 43844 - DNA, 24 bp, Homo sapiens
tgtaaacatcctacactctcagct

SEQ ID NO: 43845 - DNA, 25 bp, Homo sapiens
ctgtaaacatcctacactctcagct

SEQ ID NO: 43846 - DNA, 26 bp, Homo sapiens
actgtaaacatcctacactctcagct

SEQ ID NO: 43847 - DNA, 24 bp, Homo sapiens
ctgtaaacatcctacactctcagc

SEQ ID NO: 43848 - DNA, 25 bp, Homo sapiens
actgtaaacatcctacactctcagc

SEQ ID NO: 43849 - DNA, 22 bp, Homo sapiens
tgtaaacatcctacactctcag

SEQ ID NO: 43850 - DNA, 27 bp, Homo sapiens
gatactgtaaacatcctacactctcag

SEQ ID NO: 43851 - DNA, 21 bp, Homo sapiens
tgtaaacatcctacactctca

SEQ ID NO: 43852 - DNA, 22 bp, Homo sapiens
ctgtaaacatcctacactctca

SEQ ID NO: 43853 - DNA, 24 bp, Homo sapiens
tactgtaaacatcctacactctca

SEQ ID NO: 43854 - DNA, 19 bp, Homo sapiens
ctgtaaacatcctacactc

SEQ ID NO: 43855 - DNA, 25 bp, Homo sapiens
ctttcagtcggatgtttgcagctgc

SEQ ID NO: 43856 - DNA, 23 bp, Homo sapiens
tttcagtcggatgtttgcagctg

SEQ ID NO: 43857 - DNA, 24 bp, Homo sapiens
ctttcagtcggatgtttgcagctg

SEQ ID NO: 43858 - DNA, 22 bp, Homo sapiens
tttcagtcggatgtttgcagct

SEQ ID NO: 43859 - DNA, 23 bp, Homo sapiens
ctttcagtcggatgtttgcagct

SEQ ID NO: 43860 - DNA, 21 bp, Homo sapiens
tttcagtcggatgtttgcagc

SEQ ID NO: 43861 - DNA, 21 bp, Homo sapiens
ctttcagtcggatgtttgcag

SEQ ID NO: 43862 - DNA, 19 bp, Homo sapiens
tttcagtcggatgtttgca

SEQ ID NO: 43863 - DNA, 20 bp, Homo sapiens
ctttcagtcggatgtttgca

SEQ ID NO: 43864 - DNA, 19 bp, Homo sapiens
ctttcagtcggatgtttgc

SEQ ID NO: 43865 - DNA, 28 bp, Homo sapiens
tgtaaacatcctcgactggaagctgtga

SEQ ID NO: 43866 - DNA, 25 bp, Homo sapiens
tgtaaacatcctcgactggaagctg

SEQ ID NO: 43867 - DNA, 24 bp, Homo sapiens
tgtaaacatcctcgactggaagct

SEQ ID NO: 43868 - DNA, 23 bp, Homo sapiens
tgtaaacatcctcgactggaagc

SEQ ID NO: 43869 - DNA, 21 bp, Homo sapiens
tgtaaacatcctcgactggaa

SEQ ID NO: 43870 - DNA, 20 bp, Homo sapiens
tgtaaacatcctcgactgga

SEQ ID NO: 43871 - DNA, 19 bp, Homo sapiens
tgtaaacatcctcgactgg

SEQ ID NO: 43872 - DNA, 19 bp, Homo sapiens
taaggtttggatagatgca

SEQ ID NO: 43873 - DNA, 23 bp, Homo sapiens
taaggtttggatagatgcaataa

SEQ ID NO: 43874 - DNA, 22 bp, Homo sapiens
gtttggatagatgcaataaagt

SEQ ID NO: 43875 - DNA, 20 bp, Homo sapiens
tttggatagatgcaataaag

SEQ ID NO: 43876 - DNA, 21 bp, Homo sapiens
tttggatagatgcaataaagt

SEQ ID NO: 43877 - DNA, 22 bp, Homo sapiens
tttggatagatgcaataaagta

SEQ ID NO: 43878 - DNA, 23 bp, Homo sapiens
tttggatagatgcaataaagtat

SEQ ID NO: 43879 - DNA, 20 bp, Homo sapiens
ttggatagatgcaataaagt

SEQ ID NO: 43880 - DNA, 21 bp, Homo sapiens
tggatagatgcaataaagtat

SEQ ID NO: 43881 - DNA, 16 bp, Homo sapiens
agatgcaataaagtat

SEQ ID NO: 43882 - DNA, 20 bp, Homo sapiens
gacacatgaccataaatgct

SEQ ID NO: 43883 - DNA, 21 bp, Homo sapiens
gacacatgaccataaatgcta

SEQ ID NO: 43884 - DNA, 19 bp, Homo sapiens
accataaatgctaaagcac

SEQ ID NO: 43885 - DNA, 20 bp, Homo sapiens
accataaatgctaaagcaca

SEQ ID NO: 43886 - DNA, 18 bp, Homo sapiens
cataaatgctaaagcaca

SEQ ID NO: 43887 - DNA, 19 bp, Homo sapiens
atttgtgcttggctctgtc

SEQ ID NO: 43888 - DNA, 20 bp, Homo sapiens
atttgtgcttggctctgtca

SEQ ID NO: 43889 - DNA, 22 bp, Homo sapiens
atttgtgcttggctctgtcaca

SEQ ID NO: 43890 - DNA, 22 bp, Homo sapiens
ttgtgcttggctctgtcacatg

SEQ ID NO: 43891 - DNA, 22 bp, Homo sapiens
tgtgcttggctctgtcacatgc

SEQ ID NO: 43892 - DNA, 28 bp, Homo sapiens
aaaggtaattgcagtttttcccatttaa

SEQ ID NO: 43893 - DNA, 16 bp, Homo sapiens
cgagtctgagggaccc

SEQ ID NO: 43894 - DNA, 21 bp, Homo sapiens
gtctgagggacccaggacagg

SEQ ID NO: 43895 - DNA, 22 bp, Homo sapiens
gtctgagggacccaggacagga

SEQ ID NO: 43896 - DNA, 23 bp, Homo sapiens
gtctgagggacccaggacaggag

SEQ ID NO: 43897 - DNA, 22 bp, Homo sapiens
tctgagggacccaggacaggag

SEQ ID NO: 43898 - DNA, 23 bp, Homo sapiens
tctgagggacccaggacaggaga

SEQ ID NO: 43899 - DNA, 27 bp, Homo sapiens
tctgagggacccaggacaggagaaggc

SEQ ID NO: 43900 - DNA, 20 bp, Homo sapiens
ctgagggacccaggacagga

SEQ ID NO: 43901 - DNA, 21 bp, Homo sapiens
ctgagggacccaggacaggag

SEQ ID NO: 43902 - DNA, 22 bp, Homo sapiens
ctgagggacccaggacaggaga

SEQ ID NO: 43903 - DNA, 20 bp, Homo sapiens
tgagggacccaggacaggag

SEQ ID NO: 43904 - DNA, 22 bp, Homo sapiens
tgagggacccaggacaggagaa

SEQ ID NO: 43905 - DNA, 23 bp, Homo sapiens
tgagggacccaggacaggagaag

SEQ ID NO: 43906 - DNA, 21 bp, Homo sapiens
gagggacccaggacaggagaa

SEQ ID NO: 43907 - DNA, 19 bp, Homo sapiens
agggacccaggacaggaga

SEQ ID NO: 43908 - DNA, 20 bp, Homo sapiens
agggacccaggacaggagaa

SEQ ID NO: 43909 - DNA, 21 bp, Homo sapiens
agggacccaggacaggagaag

SEQ ID NO: 43910 - DNA, 22 bp, Homo sapiens
agggacccaggacaggagaagg

SEQ ID NO: 43911 - DNA, 22 bp, Homo sapiens
gggacccaggacaggagaaggc

SEQ ID NO: 43912 - DNA, 23 bp, Homo sapiens
gggacccaggacaggagaaggcc

SEQ ID NO: 43913 - DNA, 24 bp, Homo sapiens
gggacccaggacaggagaaggcct

SEQ ID NO: 43914 - DNA, 23 bp, Homo sapiens
ggacccaggacaggagaaggcct

SEQ ID NO: 43915 - DNA, 20 bp, Homo sapiens
gacccaggacaggagaaggc

SEQ ID NO: 43916 - DNA, 21 bp, Homo sapiens
gacccaggacaggagaaggcc

SEQ ID NO: 43917 - DNA, 20 bp, Homo sapiens
attcttcctgccctggctcc

SEQ ID NO: 43918 - DNA, 21 bp, Homo sapiens
attcttcctgccctggctcca

SEQ ID NO: 43919 - DNA, 23 bp, Homo sapiens
attcttcctgccctggctccatc

SEQ ID NO: 43920 - DNA, 24 bp, Homo sapiens
attcttcctgccctggctccatcc

SEQ ID NO: 43921 - DNA, 23 bp, Homo sapiens
ttcttcctgccctggctccatcc

SEQ ID NO: 43922 - DNA, 20 bp, Homo sapiens
tcttcctgccctggctccat

SEQ ID NO: 43923 - DNA, 22 bp, Homo sapiens
cttcctgccctggctccatcct

SEQ ID NO: 43924 - DNA, 24 bp, Homo sapiens
cttcctgccctggctccatcctca

SEQ ID NO: 43925 - DNA, 25 bp, Homo sapiens
cttcctgccctggctccatcctcag

SEQ ID NO: 43926 - DNA, 19 bp, Homo sapiens
ttcctgccctggctccatc

SEQ ID NO: 43927 - DNA, 21 bp, Homo sapiens
ttcctgccctggctccatcct

SEQ ID NO: 43928 - DNA, 24 bp, Homo sapiens
ttcctgccctggctccatcctcag

SEQ ID NO: 43929 - DNA, 20 bp, Homo sapiens
tctgagcaaggcttaacacc

SEQ ID NO: 43930 - DNA, 21 bp, Homo sapiens
tctgagcaaggcttaacacca

SEQ ID NO: 43931 - DNA, 22 bp, Homo sapiens
tctgagcaaggcttaacaccaa

SEQ ID NO: 43932 - DNA, 23 bp, Homo sapiens
tctgagcaaggcttaacaccaaa

SEQ ID NO: 43933 - DNA, 21 bp, Homo sapiens
tgagcaaggcttaacaccaaa

SEQ ID NO: 43934 - DNA, 22 bp, Homo sapiens
tgagcaaggcttaacaccaaag

SEQ ID NO: 43935 - DNA, 23 bp, Homo sapiens
tgagcaaggcttaacaccaaagg

SEQ ID NO: 43936 - DNA, 20 bp, Homo sapiens
ctggagttaagggttgcttg

SEQ ID NO: 43937 - DNA, 21 bp, Homo sapiens
tggagttaagggttgcttgga

SEQ ID NO: 43938 - DNA, 22 bp, Homo sapiens
tggagttaagggttgcttggag

SEQ ID NO: 43939 - DNA, 26 bp, Homo sapiens
tggagttaagggttgcttggagaatt

SEQ ID NO: 43940 - DNA, 22 bp, Homo sapiens
ggagttaagggttgcttggaga

SEQ ID NO: 43941 - DNA, 24 bp, Homo sapiens
ggagttaagggttgcttggagaat

SEQ ID NO: 43942 - DNA, 25 bp, Homo sapiens
ggagttaagggttgcttggagaatt

SEQ ID NO: 43943 - DNA, 21 bp, Homo sapiens
gagttaagggttgcttggaga

SEQ ID NO: 43944 - DNA, 22 bp, Homo sapiens
gagttaagggttgcttggagaa

SEQ ID NO: 43945 - DNA, 23 bp, Homo sapiens
gagttaagggttgcttggagaat

SEQ ID NO: 43946 - DNA, 17 bp, Homo sapiens
ttgcttggagaattgga

SEQ ID NO: 43947 - DNA, 21 bp, Homo sapiens
gctggggcggcgagtccgact

SEQ ID NO: 43948 - DNA, 17 bp, Homo sapiens
ggcggcgagtccgactc

SEQ ID NO: 43949 - DNA, 20 bp, Homo sapiens
ggcggcgagtccgactcatc

SEQ ID NO: 43950 - DNA, 21 bp, Homo sapiens
ggcggcgagtccgactcatca

SEQ ID NO: 43951 - DNA, 22 bp, Homo sapiens
ggcggcgagtccgactcatcaa

SEQ ID NO: 43952 - DNA, 24 bp, Homo sapiens
ggcggcgagtccgactcatcaata

SEQ ID NO: 43953 - DNA, 25 bp, Homo sapiens
ggcggcgagtccgactcatcaatat

SEQ ID NO: 43954 - DNA, 21 bp, Homo sapiens
gcggcgagtccgactcatcaa

SEQ ID NO: 43955 - DNA, 23 bp, Homo sapiens
gcggcgagtccgactcatcaata

SEQ ID NO: 43956 - DNA, 22 bp, Homo sapiens
cggcgagtccgactcatcaata

SEQ ID NO: 43957 - DNA, 21 bp, Homo sapiens
ggcgagtccgactcatcaata

SEQ ID NO: 43958 - DNA, 22 bp, Homo sapiens
ggcgagtccgactcatcaatat

SEQ ID NO: 43959 - DNA, 19 bp, Homo sapiens
cgagtccgactcatcaata

SEQ ID NO: 43960 - DNA, 18 bp, Homo sapiens
agtccgactcatcaatat

SEQ ID NO: 43961 - DNA, 17 bp, Homo sapiens
gtccgactcatcaatat

SEQ ID NO: 43962 - DNA, 23 bp, Homo sapiens
ccaaaactgcagttacttttgca

SEQ ID NO: 43963 - DNA, 17 bp, Homo sapiens
cccggggcagattggtg

SEQ ID NO: 43964 - DNA, 18 bp, Homo sapiens
cccggggcagattggtgt

SEQ ID NO: 43965 - DNA, 19 bp, Homo sapiens
cccggggcagattggtgta

SEQ ID NO: 43966 - DNA, 20 bp, Homo sapiens
cccggggcagattggtgtag

SEQ ID NO: 43967 - DNA, 21 bp, Homo sapiens
cccggggcagattggtgtagg

SEQ ID NO: 43968 - DNA, 22 bp, Homo sapiens
cccggggcagattggtgtaggg

SEQ ID NO: 43969 - DNA, 23 bp, Homo sapiens
cccggggcagattggtgtagggt

SEQ ID NO: 43970 - DNA, 24 bp, Homo sapiens
cccggggcagattggtgtagggtg

SEQ ID NO: 43971 - DNA, 25 bp, Homo sapiens
cccggggcagattggtgtagggtgc

SEQ ID NO: 43972 - DNA, 27 bp, Homo sapiens
cccggggcagattggtgtagggtgcaa

SEQ ID NO: 43973 - DNA, 19 bp, Homo sapiens
ccggggcagattggtgtag

SEQ ID NO: 43974 - DNA, 20 bp, Homo sapiens
ccggggcagattggtgtagg

SEQ ID NO: 43975 - DNA, 21 bp, Homo sapiens
ccggggcagattggtgtaggg

SEQ ID NO: 43976 - DNA, 22 bp, Homo sapiens
ccggggcagattggtgtagggt

SEQ ID NO: 43977 - DNA, 24 bp, Homo sapiens
ccggggcagattggtgtagggtgc

SEQ ID NO: 43978 - DNA, 23 bp, Homo sapiens
cggggcagattggtgtagggtgc

SEQ ID NO: 43979 - DNA, 17 bp, Homo sapiens
tggcggcggtagttatg

SEQ ID NO: 43980 - DNA, 20 bp, Homo sapiens
tggcggcggtagttatgggc

SEQ ID NO: 43981 - DNA, 21 bp, Homo sapiens
tggcggcggtagttatgggct

SEQ ID NO: 43982 - DNA, 23 bp, Homo sapiens
tggcggcggtagttatgggcttc

SEQ ID NO: 43983 - DNA, 24 bp, Homo sapiens
tggcggcggtagttatgggcttct

SEQ ID NO: 43984 - DNA, 25 bp, Homo sapiens
tggcggcggtagttatgggcttctc

SEQ ID NO: 43985 - DNA, 26 bp, Homo sapiens
tggcggcggtagttatgggcttctct

SEQ ID NO: 43986 - DNA, 27 bp, Homo sapiens
tggcggcggtagttatgggcttctctt

SEQ ID NO: 43987 - DNA, 17 bp, Homo sapiens
ggcggcggtagttatgg

SEQ ID NO: 43988 - DNA, 25 bp, Homo sapiens
tgagcgcctcgacgacagagccggc

SEQ ID NO: 43989 - DNA, 21 bp, Homo sapiens
agcgcctcgacgacagagccg

SEQ ID NO: 43990 - DNA, 22 bp, Homo sapiens
tgagcgcctcgacgacagagcc

SEQ ID NO: 43991 - DNA, 21 bp, Homo sapiens
tgagcgcctcgacgacagagc

SEQ ID NO: 43992 - DNA, 20 bp, Homo sapiens
tgagcgcctcgacgacagag

SEQ ID NO: 43993 - DNA, 19 bp, Homo sapiens
tgagcgcctcgacgacaga

SEQ ID NO: 43994 - DNA, 17 bp, Homo sapiens
tgagcgcctcgacgaca

SEQ ID NO: 43995 - DNA, 16 bp, Homo sapiens
tgagcgcctcgacgac

SEQ ID NO: 43996 - DNA, 28 bp, Homo sapiens
tccctgtcctccaggagctcacgtgtgc

SEQ ID NO: 43997 - DNA, 26 bp, Homo sapiens
tccctgtcctccaggagctcacgtgt

SEQ ID NO: 43998 - DNA, 25 bp, Homo sapiens
tccctgtcctccaggagctcacgtg

SEQ ID NO: 43999 - DNA, 23 bp, Homo sapiens
ccctgtcctccaggagctcacgt

SEQ ID NO: 44000 - DNA, 24 bp, Homo sapiens
tccctgtcctccaggagctcacgt

SEQ ID NO: 44001 - DNA, 21 bp, Homo sapiens
cctgtcctccaggagctcacg

SEQ ID NO: 44002 - DNA, 22 bp, Homo sapiens
ccctgtcctccaggagctcacg

SEQ ID NO: 44003 - DNA, 22 bp, Homo sapiens
tctccctgtcctccaggagctc

SEQ ID NO: 44004 - DNA, 20 bp, Homo sapiens
tgctacagcagggctgggga

SEQ ID NO: 44005 - DNA, 21 bp, Homo sapiens
acagcagggctggggattgca

SEQ ID NO: 44006 - DNA, 22 bp, Homo sapiens
acagcagggctggggattgcag

SEQ ID NO: 44007 - DNA, 23 bp, Homo sapiens
acagcagggctggggattgcagt

SEQ ID NO: 44008 - DNA, 21 bp, Homo sapiens
agcagggctggggattgcagt

SEQ ID NO: 44009 - DNA, 23 bp, Homo sapiens
agcagggctggggattgcagtat

SEQ ID NO: 44010 - DNA, 24 bp, Homo sapiens
gcagggctggggattgcagtatcc

SEQ ID NO: 44011 - DNA, 26 bp, Homo sapiens
ttgtgtcaatatgcgatgatgtgttg

SEQ ID NO: 44012 - DNA, 24 bp, Homo sapiens
ttgtgtcaatatgcgatgatgtgt

SEQ ID NO: 44013 - DNA, 23 bp, Homo sapiens
ttgtgtcaatatgcgatgatgtg

SEQ ID NO: 44014 - DNA, 24 bp, Homo sapiens
attgtgtcaatatgcgatgatgtg

SEQ ID NO: 44015 - DNA, 21 bp, Homo sapiens
tgtgtcaatatgcgatgatgt

SEQ ID NO: 44016 - DNA, 23 bp, Homo sapiens
attgtgtcaatatgcgatgatgt

SEQ ID NO: 44017 - DNA, 21 bp, Homo sapiens
ttgtgtcaatatgcgatgatg

SEQ ID NO: 44018 - DNA, 22 bp, Homo sapiens
attgtgtcaatatgcgatgatg

SEQ ID NO: 44019 - DNA, 20 bp, Homo sapiens
ttgtgtcaatatgcgatgat

SEQ ID NO: 44020 - DNA, 21 bp, Homo sapiens
attgtgtcaatatgcgatgat

SEQ ID NO: 44021 - DNA, 19 bp, Homo sapiens
ttgtgtcaatatgcgatga

SEQ ID NO: 44022 - DNA, 18 bp, Homo sapiens
ttgtgtcaatatgcgatg

SEQ ID NO: 44023 - DNA, 19 bp, Homo sapiens
attgtgtcaatatgcgatg

SEQ ID NO: 44024 - DNA, 17 bp, Homo sapiens
ttgtgtcaatatgcgat

SEQ ID NO: 44025 - DNA, 19 bp, Homo sapiens
cagccaggcattgctcagc

SEQ ID NO: 44026 - DNA, 17 bp, Homo sapiens
gccaggcattgctcagc

SEQ ID NO: 44027 - DNA, 25 bp, Homo sapiens
ctttttgcggtctgggcttgctgtt

SEQ ID NO: 44028 - DNA, 26 bp, Homo sapiens
ctttttgcggtctgggcttgctgttc

SEQ ID NO: 44029 - DNA, 27 bp, Homo sapiens
ctttttgcggtctgggcttgctgttcc

SEQ ID NO: 44030 - DNA, 25 bp, Homo sapiens
tttttgcggtctgggcttgctgttc

SEQ ID NO: 44031 - DNA, 22 bp, Homo sapiens
ggaagcccttaccccaaaaagt

SEQ ID NO: 44032 - DNA, 23 bp, Homo sapiens
ggaagcccttaccccaaaaagta

SEQ ID NO: 44033 - DNA, 25 bp, Homo sapiens
ggaagcccttaccccaaaaagtatc

SEQ ID NO: 44034 - DNA, 21 bp, Homo sapiens
gaagcccttaccccaaaaagt

SEQ ID NO: 44035 - DNA, 22 bp, Homo sapiens
gaagcccttaccccaaaaagta

SEQ ID NO: 44036 - DNA, 23 bp, Homo sapiens
gaagcccttaccccaaaaagtat

SEQ ID NO: 44037 - DNA, 24 bp, Homo sapiens
gaagcccttaccccaaaaagtatc

SEQ ID NO: 44038 - DNA, 20 bp, Homo sapiens
aagcccttaccccaaaaagt

SEQ ID NO: 44039 - DNA, 21 bp, Homo sapiens
aagcccttaccccaaaaagta

SEQ ID NO: 44040 - DNA, 23 bp, Homo sapiens
aagcccttaccccaaaaagtatc

SEQ ID NO: 44041 - DNA, 23 bp, Homo sapiens
tggttctagacttgccaactatg

SEQ ID NO: 44042 - DNA, 24 bp, Homo sapiens
gtggttctagacttgccaactatg

SEQ ID NO: 44043 - DNA, 25 bp, Homo sapiens
ggtggttctagacttgccaactatg

SEQ ID NO: 44044 - DNA, 22 bp, Homo sapiens
tggttctagacttgccaactat

SEQ ID NO: 44045 - DNA, 24 bp, Homo sapiens
ggtggttctagacttgccaactat

SEQ ID NO: 44046 - DNA, 22 bp, Homo sapiens
gtggttctagacttgccaacta

SEQ ID NO: 44047 - DNA, 23 bp, Homo sapiens
ggtggttctagacttgccaacta

SEQ ID NO: 44048 - DNA, 24 bp, Homo sapiens
cggtggttctagacttgccaacta

SEQ ID NO: 44049 - DNA, 19 bp, Homo sapiens
ggttctagacttgccaact

SEQ ID NO: 44050 - DNA, 20 bp, Homo sapiens
tggttctagacttgccaact

SEQ ID NO: 44051 - DNA, 21 bp, Homo sapiens
gtggttctagacttgccaact

SEQ ID NO: 44052 - DNA, 22 bp, Homo sapiens
ggtggttctagacttgccaact

SEQ ID NO: 44053 - DNA, 24 bp, Homo sapiens
ccggtggttctagacttgccaact

SEQ ID NO: 44054 - DNA, 19 bp, Homo sapiens
tggttctagacttgccaac

SEQ ID NO: 44055 - DNA, 21 bp, Homo sapiens
ggtggttctagacttgccaac

SEQ ID NO: 44056 - DNA, 19 bp, Homo sapiens
gtggttctagacttgccaa

SEQ ID NO: 44057 - DNA, 20 bp, Homo sapiens
ggtggttctagacttgccaa

SEQ ID NO: 44058 - DNA, 19 bp, Homo sapiens
ggtggttctagacttgcca

SEQ ID NO: 44059 - DNA, 27 bp, Homo sapiens
tttggcaatggtagaactcacactggt

SEQ ID NO: 44060 - DNA, 26 bp, Homo sapiens
tttggcaatggtagaactcacactgg

SEQ ID NO: 44061 - DNA, 25 bp, Homo sapiens
tttggcaatggtagaactcacactg

SEQ ID NO: 44062 - DNA, 23 bp, Homo sapiens
tttggcaatggtagaactcacac

SEQ ID NO: 44063 - DNA, 22 bp, Homo sapiens
tttggcaatggtagaactcaca

SEQ ID NO: 44064 - DNA, 20 bp, Homo sapiens
tttggcaatggtagaactca

SEQ ID NO: 44065 - DNA, 18 bp, Homo sapiens
tttggcaatggtagaact

SEQ ID NO: 44066 - DNA, 25 bp, Homo sapiens
aatcatgtgcagtgccaatatggga

SEQ ID NO: 44067 - DNA, 21 bp, Homo sapiens
atcatgtgcagtgccaatatg

SEQ ID NO: 44068 - DNA, 23 bp, Homo sapiens
caatcatgtgcagtgccaatatg

SEQ ID NO: 44069 - DNA, 21 bp, Homo sapiens
aatcatgtgcagtgccaatat

SEQ ID NO: 44070 - DNA, 22 bp, Homo sapiens
caatcatgtgcagtgccaatat

SEQ ID NO: 44071 - DNA, 20 bp, Homo sapiens
aatcatgtgcagtgccaata

SEQ ID NO: 44072 - DNA, 21 bp, Homo sapiens
caatcatgtgcagtgccaata

SEQ ID NO: 44073 - DNA, 19 bp, Homo sapiens
aatcatgtgcagtgccaat

SEQ ID NO: 44074 - DNA, 20 bp, Homo sapiens
caatcatgtgcagtgccaat

SEQ ID NO: 44075 - DNA, 17 bp, Homo sapiens
caatcatgtgcagtgcc

SEQ ID NO: 44076 - DNA, 21 bp, Homo sapiens
ctgagcaatcatgtgcagtgc

SEQ ID NO: 44077 - DNA, 20 bp, Homo sapiens
ctgagcaatcatgtgcagtg

SEQ ID NO: 44078 - DNA, 28 bp, Homo sapiens
tttggcactagcacatttttgcttgtgt

SEQ ID NO: 44079 - DNA, 25 bp, Homo sapiens
tttggcactagcacatttttgcttg

SEQ ID NO: 44080 - DNA, 24 bp, Homo sapiens
tttggcactagcacatttttgctt

SEQ ID NO: 44081 - DNA, 22 bp, Homo sapiens
ttggcactagcacatttttgct

SEQ ID NO: 44082 - DNA, 22 bp, Homo sapiens
tttggcactagcacatttttgc

SEQ ID NO: 44083 - DNA, 21 bp, Homo sapiens
tttggcactagcacatttttg

SEQ ID NO: 44084 - DNA, 20 bp, Homo sapiens
tttggcactagcacattttt

SEQ ID NO: 44085 - DNA, 17 bp, Homo sapiens
tttggcactagcacatt

SEQ ID NO: 44086 - DNA, 23 bp, Homo sapiens
tgaattaccgaagggccataaac

SEQ ID NO: 44087 - DNA, 24 bp, Homo sapiens
gtgaattaccgaagggccataaac

SEQ ID NO: 44088 - DNA, 22 bp, Homo sapiens
tgaattaccgaagggccataaa

SEQ ID NO: 44089 - DNA, 23 bp, Homo sapiens
gtgaattaccgaagggccataaa

SEQ ID NO: 44090 - DNA, 21 bp, Homo sapiens
tgaattaccgaagggccataa

SEQ ID NO: 44091 - DNA, 23 bp, Homo sapiens
agtgaattaccgaagggccataa

SEQ ID NO: 44092 - DNA, 20 bp, Homo sapiens
tgaattaccgaagggccata

SEQ ID NO: 44093 - DNA, 21 bp, Homo sapiens
gtgaattaccgaagggccata

SEQ ID NO: 44094 - DNA, 19 bp, Homo sapiens
tgaattaccgaagggccat

SEQ ID NO: 44095 - DNA, 17 bp, Homo sapiens
tgaattaccgaagggcc

SEQ ID NO: 44096 - DNA, 16 bp, Homo sapiens
tgaattaccgaagggc

SEQ ID NO: 44097 - DNA, 25 bp, Homo sapiens
tatggcactggtagaattcactgtg

SEQ ID NO: 44098 - DNA, 23 bp, Homo sapiens
atggcactggtagaattcactgt

SEQ ID NO: 44099 - DNA, 24 bp, Homo sapiens
tatggcactggtagaattcactgt

SEQ ID NO: 44100 - DNA, 22 bp, Homo sapiens
atggcactggtagaattcactg

SEQ ID NO: 44101 - DNA, 23 bp, Homo sapiens
tatggcactggtagaattcactg

SEQ ID NO: 44102 - DNA, 21 bp, Homo sapiens
atggcactggtagaattcact

SEQ ID NO: 44103 - DNA, 19 bp, Homo sapiens
atggcactggtagaattca

SEQ ID NO: 44104 - DNA, 20 bp, Homo sapiens
tatggcactggtagaattca

SEQ ID NO: 44105 - DNA, 19 bp, Homo sapiens
tatggcactggtagaattc

SEQ ID NO: 44106 - DNA, 17 bp, Homo sapiens
tatggcactggtagaat

SEQ ID NO: 44107 - DNA, 16 bp, Homo sapiens
tatggcactggtagaa

SEQ ID NO: 44108 - DNA, 16 bp, Homo sapiens
tcaagagcaataacga

SEQ ID NO: 44109 - DNA, 18 bp, Homo sapiens
tcaagagcaataacgaaa

SEQ ID NO: 44110 - DNA, 20 bp, Homo sapiens
tcaagagcaataacgaaaaa

SEQ ID NO: 44111 - DNA, 21 bp, Homo sapiens
tcaagagcaataacgaaaaat

SEQ ID NO: 44112 - DNA, 22 bp, Homo sapiens
tcaagagcaataacgaaaaatg

SEQ ID NO: 44113 - DNA, 24 bp, Homo sapiens
tcaagagcaataacgaaaaatgtt

SEQ ID NO: 44114 - DNA, 25 bp, Homo sapiens
tcaagagcaataacgaaaaatgttt

SEQ ID NO: 44115 - DNA, 27 bp, Homo sapiens
tcaagagcaataacgaaaaatgtttgt

SEQ ID NO: 44116 - DNA, 19 bp, Homo sapiens
gtttttcattattgctcct

SEQ ID NO: 44117 - DNA, 21 bp, Homo sapiens
gtttttcattattgctcctga

SEQ ID NO: 44118 - DNA, 22 bp, Homo sapiens
gtttttcattattgctcctgac

SEQ ID NO: 44119 - DNA, 23 bp, Homo sapiens
gtttttcattattgctcctgacc

SEQ ID NO: 44120 - DNA, 24 bp, Homo sapiens
gtttttcattattgctcctgacct

SEQ ID NO: 44121 - DNA, 25 bp, Homo sapiens
gtttttcattattgctcctgacctc

SEQ ID NO: 44122 - DNA, 26 bp, Homo sapiens
gtttttcattattgctcctgacctcc

SEQ ID NO: 44123 - DNA, 28 bp, Homo sapiens
gtttttcattattgctcctgacctcctc

SEQ ID NO: 44124 - DNA, 20 bp, Homo sapiens
tttttcattattgctcctga

SEQ ID NO: 44125 - DNA, 21 bp, Homo sapiens
tttttcattattgctcctgac

SEQ ID NO: 44126 - DNA, 23 bp, Homo sapiens
tttttcattattgctcctgacct

SEQ ID NO: 44127 - DNA, 24 bp, Homo sapiens
tttttcattattgctcctgacctc

SEQ ID NO: 44128 - DNA, 25 bp, Homo sapiens
tttttcattattgctcctgacctcc

SEQ ID NO: 44129 - DNA, 27 bp, Homo sapiens
tttttcattattgctcctgacctcctc

SEQ ID NO: 44130 - DNA, 21 bp, Homo sapiens
tttcattattgctcctgacct

SEQ ID NO: 44131 - DNA, 24 bp, Homo sapiens
caccatctgaaatcggttataatg

SEQ ID NO: 44132 - DNA, 21 bp, Homo sapiens
caccatctgaaatcggttata

SEQ ID NO: 44133 - DNA, 20 bp, Homo sapiens
caccatctgaaatcggttat

SEQ ID NO: 44134 - DNA, 23 bp, Homo sapiens
tagcaccatctgaaatcggttat

SEQ ID NO: 44135 - DNA, 19 bp, Homo sapiens
caccatctgaaatcggtta

SEQ ID NO: 44136 - DNA, 23 bp, Homo sapiens
ctagcaccatctgaaatcggtta

SEQ ID NO: 44137 - DNA, 18 bp, Homo sapiens
caccatctgaaatcggtt

SEQ ID NO: 44138 - DNA, 21 bp, Homo sapiens
tagcaccatctgaaatcggtt

SEQ ID NO: 44139 - DNA, 22 bp, Homo sapiens
ctagcaccatctgaaatcggtt

SEQ ID NO: 44140 - DNA, 17 bp, Homo sapiens
caccatctgaaatcggt

SEQ ID NO: 44141 - DNA, 20 bp, Homo sapiens
tagcaccatctgaaatcggt

SEQ ID NO: 44142 - DNA, 19 bp, Homo sapiens
tagcaccatctgaaatcgg

SEQ ID NO: 44143 - DNA, 24 bp, Homo sapiens
tgatttcttttggtgttcagagtc

SEQ ID NO: 44144 - DNA, 26 bp, Homo sapiens
actgatttcttttggtgttcagagtc

SEQ ID NO: 44145 - DNA, 25 bp, Homo sapiens
actgatttcttttggtgttcagagt

SEQ ID NO: 44146 - DNA, 24 bp, Homo sapiens
actgatttcttttggtgttcagag

SEQ ID NO: 44147 - DNA, 23 bp, Homo sapiens
actgatttcttttggtgttcaga

SEQ ID NO: 44148 - DNA, 21 bp, Homo sapiens
actgatttcttttggtgttca

SEQ ID NO: 44149 - DNA, 20 bp, Homo sapiens
actgatttcttttggtgttc

SEQ ID NO: 44150 - DNA, 19 bp, Homo sapiens
actgatttcttttggtgtt

SEQ ID NO: 44151 - DNA, 26 bp, Homo sapiens
caccatttgaaatcagtgttcttggg

SEQ ID NO: 44152 - DNA, 28 bp, Homo sapiens
tagcaccatttgaaatcagtgttcttgg

SEQ ID NO: 44153 - DNA, 27 bp, Homo sapiens
tagcaccatttgaaatcagtgttcttg

SEQ ID NO: 44154 - DNA, 23 bp, Homo sapiens
caccatttgaaatcagtgttctt

SEQ ID NO: 44155 - DNA, 26 bp, Homo sapiens
tagcaccatttgaaatcagtgttctt

SEQ ID NO: 44156 - DNA, 22 bp, Homo sapiens
caccatttgaaatcagtgttct

SEQ ID NO: 44157 - DNA, 25 bp, Homo sapiens
tagcaccatttgaaatcagtgttct

SEQ ID NO: 44158 - DNA, 21 bp, Homo sapiens
caccatttgaaatcagtgttc

SEQ ID NO: 44159 - DNA, 23 bp, Homo sapiens
agcaccatttgaaatcagtgttc

SEQ ID NO: 44160 - DNA, 24 bp, Homo sapiens
tagcaccatttgaaatcagtgttc

SEQ ID NO: 44161 - DNA, 25 bp, Homo sapiens
ctagcaccatttgaaatcagtgttc

SEQ ID NO: 44162 - DNA, 26 bp, Homo sapiens
gtctagcaccatttgaaatcagtgtt

SEQ ID NO: 44163 - DNA, 27 bp, Homo sapiens
tgtctagcaccatttgaaatcagtgtt

SEQ ID NO: 44164 - DNA, 22 bp, Homo sapiens
tagcaccatttgaaatcagtgt

SEQ ID NO: 44165 - DNA, 27 bp, Homo sapiens
gctggtttcatatggtggtttagattt

SEQ ID NO: 44166 - DNA, 25 bp, Homo sapiens
ctggtttcatatggtggtttagatt

SEQ ID NO: 44167 - DNA, 26 bp, Homo sapiens
gctggtttcatatggtggtttagatt

SEQ ID NO: 44168 - DNA, 25 bp, Homo sapiens
gctggtttcatatggtggtttagat

SEQ ID NO: 44169 - DNA, 23 bp, Homo sapiens
ctggtttcatatggtggtttaga

SEQ ID NO: 44170 - DNA, 23 bp, Homo sapiens
gctggtttcatatggtggtttag

SEQ ID NO: 44171 - DNA, 22 bp, Homo sapiens
gctggtttcatatggtggttta

SEQ ID NO: 44172 - DNA, 21 bp, Homo sapiens
gctggtttcatatggtggttt

SEQ ID NO: 44173 - DNA, 20 bp, Homo sapiens
gctggtttcatatggtggtt

SEQ ID NO: 44174 - DNA, 18 bp, Homo sapiens
gctggtttcatatggtgg

SEQ ID NO: 44175 - DNA, 17 bp, Homo sapiens
gctggtttcatatggtg

SEQ ID NO: 44176 - DNA, 16 bp, Homo sapiens
gctggtttcatatggt

SEQ ID NO: 44177 - DNA, 19 bp, Homo sapiens
tccagcgactggacaagct

SEQ ID NO: 44178 - DNA, 18 bp, Homo sapiens
tccagcgactggacaagc

SEQ ID NO: 44179 - DNA, 21 bp, Homo sapiens
gtgagggaggaggttgggtat

SEQ ID NO: 44180 - DNA, 22 bp, Homo sapiens
gtgagggaggaggttgggtatt

SEQ ID NO: 44181 - DNA, 21 bp, Homo sapiens
tgagggaggaggttgggtatt

SEQ ID NO: 44182 - DNA, 24 bp, Homo sapiens
tccactgccactacctaatttctc

SEQ ID NO: 44183 - DNA, 25 bp, Homo sapiens
ttccactgccactacctaatttctc

SEQ ID NO: 44184 - DNA, 25 bp, Homo sapiens
gtttccactgccactacctaatttc

SEQ ID NO: 44185 - DNA, 23 bp, Homo sapiens
tttccactgccactacctaattt

SEQ ID NO: 44186 - DNA, 22 bp, Homo sapiens
tttccactgccactacctaatt

SEQ ID NO: 44187 - DNA, 21 bp, Homo sapiens
tttccactgccactacctaat

SEQ ID NO: 44188 - DNA, 22 bp, Homo sapiens
gtttccactgccactacctaat

SEQ ID NO: 44189 - DNA, 21 bp, Homo sapiens
gtttccactgccactacctaa

SEQ ID NO: 44190 - DNA, 22 bp, Homo sapiens
ggtttccactgccactacctaa

SEQ ID NO: 44191 - DNA, 19 bp, Homo sapiens
tttccactgccactaccta

SEQ ID NO: 44192 - DNA, 19 bp, Homo sapiens
gtttccactgccactacct

SEQ ID NO: 44193 - DNA, 27 bp, Homo sapiens
attaggtagtggcagtggaacactata

SEQ ID NO: 44194 - DNA, 22 bp, Homo sapiens
taggtagtggcagtggaacact

SEQ ID NO: 44195 - DNA, 24 bp, Homo sapiens
attaggtagtggcagtggaacact

SEQ ID NO: 44196 - DNA, 22 bp, Homo sapiens
ttaggtagtggcagtggaacac

SEQ ID NO: 44197 - DNA, 23 bp, Homo sapiens
attaggtagtggcagtggaacac

SEQ ID NO: 44198 - DNA, 22 bp, Homo sapiens
attaggtagtggcagtggaaca

SEQ ID NO: 44199 - DNA, 20 bp, Homo sapiens
ttaggtagtggcagtggaac

SEQ ID NO: 44200 - DNA, 18 bp, Homo sapiens
ccatggatctccaggtgg

SEQ ID NO: 44201 - DNA, 19 bp, Homo sapiens
ccatggatctccaggtggg

SEQ ID NO: 44202 - DNA, 21 bp, Homo sapiens
ccatggatctccaggtgggtc

SEQ ID NO: 44203 - DNA, 22 bp, Homo sapiens
ccatggatctccaggtgggtca

SEQ ID NO: 44204 - DNA, 23 bp, Homo sapiens
ccatggatctccaggtgggtcaa

SEQ ID NO: 44205 - DNA, 25 bp, Homo sapiens
ccatggatctccaggtgggtcaagt

SEQ ID NO: 44206 - DNA, 23 bp, Homo sapiens
caccaacctggaggactccatgc

SEQ ID NO: 44207 - DNA, 23 bp, Homo sapiens
ccaacctggaggactccatgctg

SEQ ID NO: 44208 - DNA, 24 bp, Homo sapiens
ccaacctggaggactccatgctgt

SEQ ID NO: 44209 - DNA, 17 bp, Homo sapiens
caacctggaggactcca

SEQ ID NO: 44210 - DNA, 21 bp, Homo sapiens
caacctggaggactccatgct

SEQ ID NO: 44211 - DNA, 23 bp, Homo sapiens
caacctggaggactccatgctgt

SEQ ID NO: 44212 - DNA, 24 bp, Homo sapiens
caacctggaggactccatgctgtt

SEQ ID NO: 44213 - DNA, 25 bp, Homo sapiens
caacctggaggactccatgctgttg

SEQ ID NO: 44214 - DNA, 21 bp, Homo sapiens
aacctggaggactccatgctg

SEQ ID NO: 44215 - DNA, 21 bp, Homo sapiens
ccactcagagcagaaggatga

SEQ ID NO: 44216 - DNA, 17 bp, Homo sapiens
gtaagggaccggagagt

SEQ ID NO: 44217 - DNA, 18 bp, Homo sapiens
gtaagggaccggagagta

SEQ ID NO: 44218 - DNA, 19 bp, Homo sapiens
gtaagggaccggagagtag

SEQ ID NO: 44219 - DNA, 20 bp, Homo sapiens
gtaagggaccggagagtagg

SEQ ID NO: 44220 - DNA, 22 bp, Homo sapiens
gtaagggaccggagagtaggaa

SEQ ID NO: 44221 - DNA, 23 bp, Homo sapiens
gtaagggaccggagagtaggaaa

SEQ ID NO: 44222 - DNA, 24 bp, Homo sapiens
gtaagggaccggagagtaggaaaa

SEQ ID NO: 44223 - DNA, 25 bp, Homo sapiens
gtaagggaccggagagtaggaaaag

SEQ ID NO: 44224 - DNA, 26 bp, Homo sapiens
gtaagggaccggagagtaggaaaagc

SEQ ID NO: 44225 - DNA, 27 bp, Homo sapiens
gtaagggaccggagagtaggaaaagca

SEQ ID NO: 44226 - DNA, 20 bp, Homo sapiens
taagggaccggagagtagga

SEQ ID NO: 44227 - DNA, 22 bp, Homo sapiens
taagggaccggagagtaggaaa

SEQ ID NO: 44228 - DNA, 25 bp, Homo sapiens
taagggaccggagagtaggaaaagc

SEQ ID NO: 44229 - DNA, 26 bp, Homo sapiens
ctctcttccctctcccaccccttgca

SEQ ID NO: 44230 - DNA, 21 bp, Homo sapiens
tctcttccctctcccacccct

SEQ ID NO: 44231 - DNA, 26 bp, Homo sapiens
tctcttccctctcccaccccttgcag

SEQ ID NO: 44232 - DNA, 24 bp, Homo sapiens
ctcttccctctcccaccccttgca

SEQ ID NO: 44233 - DNA, 20 bp, Homo sapiens
cttccctctcccaccccttg

SEQ ID NO: 44234 - DNA, 19 bp, Homo sapiens
ttccctctcccaccccttg

SEQ ID NO: 44235 - DNA, 22 bp, Homo sapiens
ttccctctcccaccccttgcag

SEQ ID NO: 44236 - DNA, 23 bp, Homo sapiens
ttccctctcccaccccttgcagg

SEQ ID NO: 44237 - DNA, 24 bp, Homo sapiens
ttccctctcccaccccttgcaggt

SEQ ID NO: 44238 - DNA, 22 bp, Homo sapiens
tccctctcccaccccttgcagg

SEQ ID NO: 44239 - DNA, 23 bp, Homo sapiens
tccctctcccaccccttgcaggt

SEQ ID NO: 44240 - DNA, 22 bp, Homo sapiens
ccctctcccaccccttgcaggt

SEQ ID NO: 44241 - DNA, 18 bp, Homo sapiens
ctctcccaccccttgcag

SEQ ID NO: 44242 - DNA, 21 bp, Homo sapiens
tctcccaccccttgcaggtgt

SEQ ID NO: 44243 - DNA, 22 bp, Homo sapiens
tctcccaccccttgcaggtgtc

SEQ ID NO: 44244 - DNA, 21 bp, Homo sapiens
aaactgtaattacttttggaa

SEQ ID NO: 44245 - DNA, 22 bp, Homo sapiens
aaaactgtaattacttttggaa

SEQ ID NO: 44246 - DNA, 23 bp, Homo sapiens
aaaaactgtaattacttttggaa

SEQ ID NO: 44247 - DNA, 18 bp, Homo sapiens
aggaagccctggaggggc

SEQ ID NO: 44248 - DNA, 19 bp, Homo sapiens
aggaagccctggaggggct

SEQ ID NO: 44249 - DNA, 20 bp, Homo sapiens
aggaagccctggaggggctg

SEQ ID NO: 44250 - DNA, 21 bp, Homo sapiens
aggaagccctggaggggctgg

SEQ ID NO: 44251 - DNA, 22 bp, Homo sapiens
aggaagccctggaggggctgga

SEQ ID NO: 44252 - DNA, 24 bp, Homo sapiens
aggaagccctggaggggctggagg

SEQ ID NO: 44253 - DNA, 25 bp, Homo sapiens
aggaagccctggaggggctggaggt

SEQ ID NO: 44254 - DNA, 26 bp, Homo sapiens
aggaagccctggaggggctggaggtg

SEQ ID NO: 44255 - DNA, 27 bp, Homo sapiens
aggaagccctggaggggctggaggtga

SEQ ID NO: 44256 - DNA, 22 bp, Homo sapiens
ctccggttctcagggctccacc

SEQ ID NO: 44257 - DNA, 18 bp, Homo sapiens
tccggttctcagggctcc

SEQ ID NO: 44258 - DNA, 19 bp, Homo sapiens
tccggttctcagggctcca

SEQ ID NO: 44259 - DNA, 20 bp, Homo sapiens
tccggttctcagggctccac

SEQ ID NO: 44260 - DNA, 22 bp, Homo sapiens
tccggttctcagggctccacct

SEQ ID NO: 44261 - DNA, 23 bp, Homo sapiens
tccggttctcagggctccacctc

SEQ ID NO: 44262 - DNA, 24 bp, Homo sapiens
tccggttctcagggctccacctct

SEQ ID NO: 44263 - DNA, 21 bp, Homo sapiens
cggttctcagggctccacctc

SEQ ID NO: 44264 - DNA, 22 bp, Homo sapiens
gtgctccaggctggctcacacc

SEQ ID NO: 44265 - DNA, 21 bp, Homo sapiens
ggtgctccaggctggctcaca

SEQ ID NO: 44266 - DNA, 20 bp, Homo sapiens
aggtgctccaggctggctca

SEQ ID NO: 44267 - DNA, 27 bp, Homo sapiens
tgcatagtcacaaaagtgatcattgga

SEQ ID NO: 44268 - DNA, 28 bp, Homo sapiens
ttgcatagtcacaaaagtgatcattgga

SEQ ID NO: 44269 - DNA, 24 bp, Homo sapiens
gcccagttgcatagtcacaaaagt

SEQ ID NO: 44270 - DNA, 20 bp, Homo sapiens
gcccagttgcatagtcacaa

SEQ ID NO: 44271 - DNA, 25 bp, Homo sapiens
gtcatttttgtgatgttgcagctag

SEQ ID NO: 44272 - DNA, 24 bp, Homo sapiens
gtcatttttgtgatgttgcagcta

SEQ ID NO: 44273 - DNA, 21 bp, Homo sapiens
catttttgtgatgttgcagct

SEQ ID NO: 44274 - DNA, 23 bp, Homo sapiens
gtcatttttgtgatgttgcagct

SEQ ID NO: 44275 - DNA, 22 bp, Homo sapiens
gtcatttttgtgatgttgcagc

SEQ ID NO: 44276 - DNA, 21 bp, Homo sapiens
gtcatttttgtgatgttgcag

SEQ ID NO: 44277 - DNA, 20 bp, Homo sapiens
gtcatttttgtgatgttgca

SEQ ID NO: 44278 - DNA, 17 bp, Homo sapiens
gtcatttttgtgatgtt

SEQ ID NO: 44279 - DNA, 18 bp, Homo sapiens
aagaacacgtttgaatgc

SEQ ID NO: 44280 - DNA, 20 bp, Homo sapiens
aagaacacgtttgaatgctg

SEQ ID NO: 44281 - DNA, 23 bp, Homo sapiens
aagaacacgtttgaatgctgtac

SEQ ID NO: 44282 - DNA, 16 bp, Homo sapiens
gtccccggggagcccc

SEQ ID NO: 44283 - DNA, 23 bp, Homo sapiens
ccctcgtcaggtccccggggagc

SEQ ID NO: 44284 - DNA, 24 bp, Homo sapiens
accctcgtcaggtccccggggagc

SEQ ID NO: 44285 - DNA, 22 bp, Homo sapiens
ccctcgtcaggtccccggggag

SEQ ID NO: 44286 - DNA, 23 bp, Homo sapiens
accctcgtcaggtccccggggag

SEQ ID NO: 44287 - DNA, 20 bp, Homo sapiens
accctcgtcaggtccccggg

SEQ ID NO: 44288 - DNA, 16 bp, Homo sapiens
ctcgtcaggtccccgg

SEQ ID NO: 44289 - DNA, 24 bp, Homo sapiens
caccggggatggcagagggtcgtg

SEQ ID NO: 44290 - DNA, 25 bp, Homo sapiens
acaccggggatggcagagggtcgtg

SEQ ID NO: 44291 - DNA, 23 bp, Homo sapiens
acaccggggatggcagagggtcg

SEQ ID NO: 44292 - DNA, 21 bp, Homo sapiens
caccggggatggcagagggtc

SEQ ID NO: 44293 - DNA, 22 bp, Homo sapiens
acaccggggatggcagagggtc

SEQ ID NO: 44294 - DNA, 21 bp, Homo sapiens
acaccggggatggcagagggt

SEQ ID NO: 44295 - DNA, 20 bp, Homo sapiens
acaccggggatggcagaggg

SEQ ID NO: 44296 - DNA, 18 bp, Homo sapiens
caccggggatggcagagg

SEQ ID NO: 44297 - DNA, 19 bp, Homo sapiens
acaccggggatggcagagg

SEQ ID NO: 44298 - DNA, 20 bp, Homo sapiens
cacaccggggatggcagagg

SEQ ID NO: 44299 - DNA, 25 bp, Homo sapiens
catgctaggatagaaagaatgggac

SEQ ID NO: 44300 - DNA, 24 bp, Homo sapiens
catgctaggatagaaagaatggga

SEQ ID NO: 44301 - DNA, 23 bp, Homo sapiens
catgctaggatagaaagaatggg

SEQ ID NO: 44302 - DNA, 19 bp, Homo sapiens
gctaggatagaaagaatgg

SEQ ID NO: 44303 - DNA, 20 bp, Homo sapiens
tgctaggatagaaagaatgg

SEQ ID NO: 44304 - DNA, 21 bp, Homo sapiens
atgctaggatagaaagaatgg

SEQ ID NO: 44305 - DNA, 23 bp, Homo sapiens
tcatgctaggatagaaagaatgg

SEQ ID NO: 44306 - DNA, 18 bp, Homo sapiens
catgctaggatagaaaga

SEQ ID NO: 44307 - DNA, 24 bp, Homo sapiens
atgcctcccccggccccgcaggac

SEQ ID NO: 44308 - DNA, 22 bp, Homo sapiens
tgcctcccccggccccgcagga

SEQ ID NO: 44309 - DNA, 23 bp, Homo sapiens
atgcctcccccggccccgcagga

SEQ ID NO: 44310 - DNA, 21 bp, Homo sapiens
tgcctcccccggccccgcagg

SEQ ID NO: 44311 - DNA, 22 bp, Homo sapiens
atgcctcccccggccccgcagg

SEQ ID NO: 44312 - DNA, 20 bp, Homo sapiens
tgcctcccccggccccgcag

SEQ ID NO: 44313 - DNA, 20 bp, Homo sapiens
atgcctcccccggccccgca

SEQ ID NO: 44314 - DNA, 22 bp, Homo sapiens
cagggccctggcgcaggcatcc

SEQ ID NO: 44315 - DNA, 24 bp, Homo sapiens
cgcagggccctggcgcaggcatcc

SEQ ID NO: 44316 - DNA, 25 bp, Homo sapiens
ccgcagggccctggcgcaggcatcc

SEQ ID NO: 44317 - DNA, 26 bp, Homo sapiens
tccgcagggccctggcgcaggcatcc

SEQ ID NO: 44318 - DNA, 21 bp, Homo sapiens
cagggccctggcgcaggcatc

SEQ ID NO: 44319 - DNA, 23 bp, Homo sapiens
cgcagggccctggcgcaggcatc

SEQ ID NO: 44320 - DNA, 25 bp, Homo sapiens
tccgcagggccctggcgcaggcatc

SEQ ID NO: 44321 - DNA, 23 bp, Homo sapiens
ccgcagggccctggcgcaggcat

SEQ ID NO: 44322 - DNA, 24 bp, Homo sapiens
tccgcagggccctggcgcaggcat

SEQ ID NO: 44323 - DNA, 21 bp, Homo sapiens
cgcagggccctggcgcaggca

SEQ ID NO: 44324 - DNA, 23 bp, Homo sapiens
tccgcagggccctggcgcaggca

SEQ ID NO: 44325 - DNA, 20 bp, Homo sapiens
cgcagggccctggcgcaggc

SEQ ID NO: 44326 - DNA, 21 bp, Homo sapiens
tccgcagggccctggcgcagg

SEQ ID NO: 44327 - DNA, 20 bp, Homo sapiens
tccgcagggccctggcgcag

SEQ ID NO: 44328 - DNA, 19 bp, Homo sapiens
ttgtgggactgcaaatggg

SEQ ID NO: 44329 - DNA, 21 bp, Homo sapiens
ttgtgggactgcaaatgggag

SEQ ID NO: 44330 - DNA, 22 bp, Homo sapiens
ttgtgggactgcaaatgggagc

SEQ ID NO: 44331 - DNA, 24 bp, Homo sapiens
ttgtgggactgcaaatgggagctc

SEQ ID NO: 44332 - DNA, 21 bp, Homo sapiens
tgtgggactgcaaatgggagc

SEQ ID NO: 44333 - DNA, 22 bp, Homo sapiens
tgtgggactgcaaatgggagct

SEQ ID NO: 44334 - DNA, 23 bp, Homo sapiens
tgtgggactgcaaatgggagctc

SEQ ID NO: 44335 - DNA, 24 bp, Homo sapiens
tgtgggactgcaaatgggagctca

SEQ ID NO: 44336 - DNA, 26 bp, Homo sapiens
tcagtgcactacagaactttgtctct

SEQ ID NO: 44337 - DNA, 25 bp, Homo sapiens
tcagtgcactacagaactttgtctc

SEQ ID NO: 44338 - DNA, 24 bp, Homo sapiens
tcagtgcactacagaactttgtct

SEQ ID NO: 44339 - DNA, 23 bp, Homo sapiens
tcagtgcactacagaactttgtc

SEQ ID NO: 44340 - DNA, 21 bp, Homo sapiens
tcagtgcactacagaactttg

SEQ ID NO: 44341 - DNA, 20 bp, Homo sapiens
tcagtgcactacagaacttt

SEQ ID NO: 44342 - DNA, 28 bp, Homo sapiens
aaagttctgagacactccgactctgagt

SEQ ID NO: 44343 - DNA, 24 bp, Homo sapiens
aaagttctgagacactccgactct

SEQ ID NO: 44344 - DNA, 22 bp, Homo sapiens
aagttctgagacactccgactc

SEQ ID NO: 44345 - DNA, 23 bp, Homo sapiens
aaagttctgagacactccgactc

SEQ ID NO: 44346 - DNA, 24 bp, Homo sapiens
caaagttctgagacactccgactc

SEQ ID NO: 44347 - DNA, 23 bp, Homo sapiens
caaagttctgagacactccgact

SEQ ID NO: 44348 - DNA, 21 bp, Homo sapiens
aaagttctgagacactccgac

SEQ ID NO: 44349 - DNA, 22 bp, Homo sapiens
caaagttctgagacactccgac

SEQ ID NO: 44350 - DNA, 20 bp, Homo sapiens
aaagttctgagacactccga

SEQ ID NO: 44351 - DNA, 21 bp, Homo sapiens
caaagttctgagacactccga

SEQ ID NO: 44352 - DNA, 19 bp, Homo sapiens
aaagttctgagacactccg

SEQ ID NO: 44353 - DNA, 18 bp, Homo sapiens
aaagttctgagacactcc

SEQ ID NO: 44354 - DNA, 23 bp, Homo sapiens
gacagcacgacactgccttcatt

SEQ ID NO: 44355 - DNA, 24 bp, Homo sapiens
cgacagcacgacactgccttcatt

SEQ ID NO: 44356 - DNA, 25 bp, Homo sapiens
tcgacagcacgacactgccttcatt

SEQ ID NO: 44357 - DNA, 27 bp, Homo sapiens
tctcgacagcacgacactgccttcatt

SEQ ID NO: 44358 - DNA, 24 bp, Homo sapiens
tcgacagcacgacactgccttcat

SEQ ID NO: 44359 - DNA, 22 bp, Homo sapiens
cgacagcacgacactgccttca

SEQ ID NO: 44360 - DNA, 23 bp, Homo sapiens
tcgacagcacgacactgccttca

SEQ ID NO: 44361 - DNA, 20 bp, Homo sapiens
tcgacagcacgacactgcct

SEQ ID NO: 44362 - DNA, 19 bp, Homo sapiens
tcgacagcacgacactgcc

SEQ ID NO: 44363 - DNA, 25 bp, Homo sapiens
gtagtttcctgttgttgggatccac

SEQ ID NO: 44364 - DNA, 27 bp, Homo sapiens
aggtagtttcctgttgttgggatccac

SEQ ID NO: 44365 - DNA, 22 bp, Homo sapiens
gtagtttcctgttgttgggatc

SEQ ID NO: 44366 - DNA, 25 bp, Homo sapiens
taggtagtttcctgttgttgggatc

SEQ ID NO: 44367 - DNA, 21 bp, Homo sapiens
gtagtttcctgttgttgggat

SEQ ID NO: 44368 - DNA, 24 bp, Homo sapiens
taggtagtttcctgttgttgggat

SEQ ID NO: 44369 - DNA, 20 bp, Homo sapiens
gtagtttcctgttgttggga

SEQ ID NO: 44370 - DNA, 23 bp, Homo sapiens
taggtagtttcctgttgttggga

SEQ ID NO: 44371 - DNA, 18 bp, Homo sapiens
gtagtttcctgttgttgg

SEQ ID NO: 44372 - DNA, 20 bp, Homo sapiens
aggtagtttcctgttgttgg

SEQ ID NO: 44373 - DNA, 21 bp, Homo sapiens
taggtagtttcctgttgttgg

SEQ ID NO: 44374 - DNA, 20 bp, Homo sapiens
taggtagtttcctgttgttg

SEQ ID NO: 44375 - DNA, 22 bp, Homo sapiens
tcttactccctcaggcacatct

SEQ ID NO: 44376 - DNA, 23 bp, Homo sapiens
gtcttactccctcaggcacatct

SEQ ID NO: 44377 - DNA, 23 bp, Homo sapiens
tgtcttactccctcaggcacatc

SEQ ID NO: 44378 - DNA, 21 bp, Homo sapiens
gtcttactccctcaggcacat

SEQ ID NO: 44379 - DNA, 21 bp, Homo sapiens
tgtcttactccctcaggcaca

SEQ ID NO: 44380 - DNA, 24 bp, Homo sapiens
tgcctgagggagtaagagtcctgt

SEQ ID NO: 44381 - DNA, 25 bp, Homo sapiens
gtgcctgagggagtaagagtcctgt

SEQ ID NO: 44382 - DNA, 23 bp, Homo sapiens
tgcctgagggagtaagagtcctg

SEQ ID NO: 44383 - DNA, 25 bp, Homo sapiens
agtgcctgagggagtaagagtcctg

SEQ ID NO: 44384 - DNA, 22 bp, Homo sapiens
tgcctgagggagtaagagtcct

SEQ ID NO: 44385 - DNA, 23 bp, Homo sapiens
gtgcctgagggagtaagagtcct

SEQ ID NO: 44386 - DNA, 24 bp, Homo sapiens
agtgcctgagggagtaagagtcct

SEQ ID NO: 44387 - DNA, 21 bp, Homo sapiens
tgcctgagggagtaagagtcc

SEQ ID NO: 44388 - DNA, 22 bp, Homo sapiens
gtgcctgagggagtaagagtcc

SEQ ID NO: 44389 - DNA, 23 bp, Homo sapiens
agtgcctgagggagtaagagtcc

SEQ ID NO: 44390 - DNA, 20 bp, Homo sapiens
tgcctgagggagtaagagtc

SEQ ID NO: 44391 - DNA, 21 bp, Homo sapiens
gtgcctgagggagtaagagtc

SEQ ID NO: 44392 - DNA, 22 bp, Homo sapiens
agtgcctgagggagtaagagtc

SEQ ID NO: 44393 - DNA, 19 bp, Homo sapiens
tgcctgagggagtaagagt

SEQ ID NO: 44394 - DNA, 20 bp, Homo sapiens
gtgcctgagggagtaagagt

SEQ ID NO: 44395 - DNA, 21 bp, Homo sapiens
agtgcctgagggagtaagagt

SEQ ID NO: 44396 - DNA, 22 bp, Homo sapiens
cagtgcctgagggagtaagagt

SEQ ID NO: 44397 - DNA, 16 bp, Homo sapiens
gtaagagccctgttgt

SEQ ID NO: 44398 - DNA, 27 bp, Homo sapiens
agatagtgtcttactccctcaggcaca

SEQ ID NO: 44399 - DNA, 26 bp, Homo sapiens
caaaagtaattgtggattttgtcgtt

SEQ ID NO: 44400 - DNA, 23 bp, Homo sapiens
aaaagtaattgtggattttgtcg

SEQ ID NO: 44401 - DNA, 22 bp, Homo sapiens
aaaagtaattgtggattttgtc

SEQ ID NO: 44402 - DNA, 21 bp, Homo sapiens
aaaagtaattgtggattttgt

SEQ ID NO: 44403 - DNA, 22 bp, Homo sapiens
tctcctgagccattctgagcct

SEQ ID NO: 44404 - DNA, 25 bp, Homo sapiens
acttctcctgagccattctgagcct

SEQ ID NO: 44405 - DNA, 18 bp, Homo sapiens
tagcccccaggcttcact

SEQ ID NO: 44406 - DNA, 20 bp, Homo sapiens
tagcccccaggcttcacttg

SEQ ID NO: 44407 - DNA, 21 bp, Homo sapiens
tagcccccaggcttcacttgg

SEQ ID NO: 44408 - DNA, 22 bp, Homo sapiens
tagcccccaggcttcacttggc

SEQ ID NO: 44409 - DNA, 24 bp, Homo sapiens
tagcccccaggcttcacttggcgt

SEQ ID NO: 44410 - DNA, 25 bp, Homo sapiens
tagcccccaggcttcacttggcgtg

SEQ ID NO: 44411 - DNA, 25 bp, Homo sapiens
gtgggaccagggccagcagggaatg

SEQ ID NO: 44412 - DNA, 24 bp, Homo sapiens
ggaccagggccagcagggaatgtc

SEQ ID NO: 44413 - DNA, 22 bp, Homo sapiens
gaccagggccagcagggaatgt

SEQ ID NO: 44414 - DNA, 23 bp, Homo sapiens
gaccagggccagcagggaatgtc

SEQ ID NO: 44415 - DNA, 24 bp, Homo sapiens
gaccagggccagcagggaatgtca

SEQ ID NO: 44416 - DNA, 19 bp, Homo sapiens
accagggccagcagggaat

SEQ ID NO: 44417 - DNA, 20 bp, Homo sapiens
accagggccagcagggaatg

SEQ ID NO: 44418 - DNA, 22 bp, Homo sapiens
accagggccagcagggaatgtc

SEQ ID NO: 44419 - DNA, 23 bp, Homo sapiens
accagggccagcagggaatgtca

SEQ ID NO: 44420 - DNA, 20 bp, Homo sapiens
ccagggccagcagggaatgt

SEQ ID NO: 44421 - DNA, 21 bp, Homo sapiens
ccagggccagcagggaatgtc

SEQ ID NO: 44422 - DNA, 23 bp, Homo sapiens
cagggccagcagggaatgtcagg

SEQ ID NO: 44423 - DNA, 27 bp, Homo sapiens
cctgaccttcactgtgactctgctgca

SEQ ID NO: 44424 - DNA, 21 bp, Homo sapiens
tgaccttcactgtgactctgc

SEQ ID NO: 44425 - DNA, 22 bp, Homo sapiens
tgaccttcactgtgactctgct

SEQ ID NO: 44426 - DNA, 20 bp, Homo sapiens
ccttcactgtgactctgctg

SEQ ID NO: 44427 - DNA, 21 bp, Homo sapiens
ccttcactgtgactctgctgc

SEQ ID NO: 44428 - DNA, 22 bp, Homo sapiens
ccttcactgtgactctgctgca

SEQ ID NO: 44429 - DNA, 24 bp, Homo sapiens
ccttcactgtgactctgctgcaga

SEQ ID NO: 44430 - DNA, 20 bp, Homo sapiens
ctgtgactctgctgcagagg

SEQ ID NO: 44431 - DNA, 22 bp, Homo sapiens
agtcctgcttctgttgcagaag

SEQ ID NO: 44432 - DNA, 23 bp, Homo sapiens
aagtcctgcttctgttgcagaag

SEQ ID NO: 44433 - DNA, 22 bp, Homo sapiens
aagtcctgcttctgttgcagaa

SEQ ID NO: 44434 - DNA, 23 bp, Homo sapiens
gaagtcctgcttctgttgcagaa

SEQ ID NO: 44435 - DNA, 21 bp, Homo sapiens
aagtcctgcttctgttgcaga

SEQ ID NO: 44436 - DNA, 22 bp, Homo sapiens
gaagtcctgcttctgttgcaga

SEQ ID NO: 44437 - DNA, 25 bp, Homo sapiens
acggaagtcctgcttctgttgcaga

SEQ ID NO: 44438 - DNA, 27 bp, Homo sapiens
tcacggaagtcctgcttctgttgcaga

SEQ ID NO: 44439 - DNA, 19 bp, Homo sapiens
aagtcctgcttctgttgca

SEQ ID NO: 44440 - DNA, 19 bp, Homo sapiens
tcacggaagtcctgcttct

SEQ ID NO: 44441 - DNA, 18 bp, Homo sapiens
tcacggaagtcctgcttc

SEQ ID NO: 44442 - DNA, 17 bp, Homo sapiens
tcacggaagtcctgctt

SEQ ID NO: 44443 - DNA, 24 bp, Homo sapiens
agcagcagtggcaagactcctagg

SEQ ID NO: 44444 - DNA, 21 bp, Homo sapiens
cagcagtggcaagactcctag

SEQ ID NO: 44445 - DNA, 23 bp, Homo sapiens
agcagcagtggcaagactcctag

SEQ ID NO: 44446 - DNA, 24 bp, Homo sapiens
aagcagcagtggcaagactcctag

SEQ ID NO: 44447 - DNA, 22 bp, Homo sapiens
agcagcagtggcaagactccta

SEQ ID NO: 44448 - DNA, 21 bp, Homo sapiens
agcagcagtggcaagactcct

SEQ ID NO: 44449 - DNA, 23 bp, Homo sapiens
gaagcagcagtggcaagactcct

SEQ ID NO: 44450 - DNA, 21 bp, Homo sapiens
aagcagcagtggcaagactcc

SEQ ID NO: 44451 - DNA, 22 bp, Homo sapiens
gaagcagcagtggcaagactcc

SEQ ID NO: 44452 - DNA, 20 bp, Homo sapiens
aagcagcagtggcaagactc

SEQ ID NO: 44453 - DNA, 21 bp, Homo sapiens
gaagcagcagtggcaagactc

SEQ ID NO: 44454 - DNA, 18 bp, Homo sapiens
agcagcagtggcaagact

SEQ ID NO: 44455 - DNA, 19 bp, Homo sapiens
aagcagcagtggcaagact

SEQ ID NO: 44456 - DNA, 20 bp, Homo sapiens
gaagcagcagtggcaagact

SEQ ID NO: 44457 - DNA, 19 bp, Homo sapiens
attgtctgggcgaggggtg

SEQ ID NO: 44458 - DNA, 24 bp, Homo sapiens
gtctgggcgaggggtgggctctca

SEQ ID NO: 44459 - DNA, 25 bp, Homo sapiens
tctgggcgaggggtgggctctcaga

SEQ ID NO: 44460 - DNA, 23 bp, Homo sapiens
ctgggcgaggggtgggctctcag

SEQ ID NO: 44461 - DNA, 24 bp, Homo sapiens
ctgggcgaggggtgggctctcaga

SEQ ID NO: 44462 - DNA, 18 bp, Homo sapiens
tgggcgaggggtgggctc

SEQ ID NO: 44463 - DNA, 22 bp, Homo sapiens
tgggcgaggggtgggctctcag

SEQ ID NO: 44464 - DNA, 23 bp, Homo sapiens
tgggcgaggggtgggctctcaga

SEQ ID NO: 44465 - DNA, 25 bp, Homo sapiens
tgggcgaggggtgggctctcagagg

SEQ ID NO: 44466 - DNA, 26 bp, Homo sapiens
tgggcgaggggtgggctctcagaggg

SEQ ID NO: 44467 - DNA, 20 bp, Homo sapiens
gggcgaggggtgggctctca

SEQ ID NO: 44468 - DNA, 21 bp, Homo sapiens
cgaggggtgggctctcagagg

SEQ ID NO: 44469 - DNA, 23 bp, Homo sapiens
cgaggggtgggctctcagagggg

SEQ ID NO: 44470 - DNA, 24 bp, Homo sapiens
cgaggggtgggctctcagaggggc

SEQ ID NO: 44471 - DNA, 22 bp, Homo sapiens
ctctgaggcctgcctctcccca

SEQ ID NO: 44472 - DNA, 20 bp, Homo sapiens
tctgaggcctgcctctcccc

SEQ ID NO: 44473 - DNA, 22 bp, Homo sapiens
tctgaggcctgcctctccccag

SEQ ID NO: 44474 - DNA, 23 bp, Homo sapiens
tctgaggcctgcctctccccaga

SEQ ID NO: 44475 - DNA, 25 bp, Homo sapiens
tctgaggcctgcctctccccagacc

SEQ ID NO: 44476 - DNA, 19 bp, Homo sapiens
ctgaggcctgcctctcccc

SEQ ID NO: 44477 - DNA, 20 bp, Homo sapiens
ctgaggcctgcctctcccca

SEQ ID NO: 44478 - DNA, 21 bp, Homo sapiens
ctgaggcctgcctctccccag

SEQ ID NO: 44479 - DNA, 22 bp, Homo sapiens
ctgaggcctgcctctccccaga

SEQ ID NO: 44480 - DNA, 23 bp, Homo sapiens
ctgaggcctgcctctccccagac

SEQ ID NO: 44481 - DNA, 24 bp, Homo sapiens
ctgaggcctgcctctccccagacc

SEQ ID NO: 44482 - DNA, 18 bp, Homo sapiens
tgaggcctgcctctcccc

SEQ ID NO: 44483 - DNA, 20 bp, Homo sapiens
tgaggcctgcctctccccag

SEQ ID NO: 44484 - DNA, 21 bp, Homo sapiens
tgaggcctgcctctccccaga

SEQ ID NO: 44485 - DNA, 22 bp, Homo sapiens
tgaggcctgcctctccccagac

SEQ ID NO: 44486 - DNA, 23 bp, Homo sapiens
tgaggcctgcctctccccagacc

SEQ ID NO: 44487 - DNA, 23 bp, Homo sapiens
gaagtggtctgaggcatatagag

SEQ ID NO: 44488 - DNA, 23 bp, Homo sapiens
gtggaagtggtctgaggcatata

SEQ ID NO: 44489 - DNA, 26 bp, Homo sapiens
aatgtggaagtggtctgaggcatata

SEQ ID NO: 44490 - DNA, 25 bp, Homo sapiens
aatgtggaagtggtctgaggcatat

SEQ ID NO: 44491 - DNA, 23 bp, Homo sapiens
atgtggaagtggtctgaggcata

SEQ ID NO: 44492 - DNA, 24 bp, Homo sapiens
aatgtggaagtggtctgaggcata

SEQ ID NO: 44493 - DNA, 27 bp, Homo sapiens
aagaatgtggaagtggtctgaggcata

SEQ ID NO: 44494 - DNA, 22 bp, Homo sapiens
aatgtggaagtggtctgaggca

SEQ ID NO: 44495 - DNA, 25 bp, Homo sapiens
aagaatgtggaagtggtctgaggca

SEQ ID NO: 44496 - DNA, 21 bp, Homo sapiens
aatgtggaagtggtctgaggc

SEQ ID NO: 44497 - DNA, 24 bp, Homo sapiens
aagaatgtggaagtggtctgaggc

SEQ ID NO: 44498 - DNA, 20 bp, Homo sapiens
aatgtggaagtggtctgagg

SEQ ID NO: 44499 - DNA, 22 bp, Homo sapiens
aagaatgtggaagtggtctgag

SEQ ID NO: 44500 - DNA, 26 bp, Homo sapiens
tgggctgagggcaggaggcctgtggc

SEQ ID NO: 44501 - DNA, 25 bp, Homo sapiens
tgggctgagggcaggaggcctgtgg

SEQ ID NO: 44502 - DNA, 24 bp, Homo sapiens
tgggctgagggcaggaggcctgtg

SEQ ID NO: 44503 - DNA, 22 bp, Homo sapiens
tgggctgagggcaggaggcctg

SEQ ID NO: 44504 - DNA, 21 bp, Homo sapiens
tgggctgagggcaggaggcct

SEQ ID NO: 44505 - DNA, 27 bp, Homo sapiens
tcagaacaaatgccggttcccagacgc

SEQ ID NO: 44506 - DNA, 25 bp, Homo sapiens
tcagaacaaatgccggttcccagac

SEQ ID NO: 44507 - DNA, 22 bp, Homo sapiens
agaacaaatgccggttcccaga

SEQ ID NO: 44508 - DNA, 21 bp, Homo sapiens
agaacaaatgccggttcccag

SEQ ID NO: 44509 - DNA, 23 bp, Homo sapiens
tcagaacaaatgccggttcccag

SEQ ID NO: 44510 - DNA, 20 bp, Homo sapiens
agaacaaatgccggttccca

SEQ ID NO: 44511 - DNA, 21 bp, Homo sapiens
cagaacaaatgccggttccca

SEQ ID NO: 44512 - DNA, 22 bp, Homo sapiens
tcagaacaaatgccggttccca

SEQ ID NO: 44513 - DNA, 21 bp, Homo sapiens
tcagaacaaatgccggttccc

SEQ ID NO: 44514 - DNA, 20 bp, Homo sapiens
tcagaacaaatgccggttcc

SEQ ID NO: 44515 - DNA, 19 bp, Homo sapiens
tcagaacaaatgccggttc

SEQ ID NO: 44516 - DNA, 18 bp, Homo sapiens
tcagaacaaatgccggtt

SEQ ID NO: 44517 - DNA, 25 bp, Homo sapiens
tgagaaccacgtctgctctgagctg

SEQ ID NO: 44518 - DNA, 24 bp, Homo sapiens
tgagaaccacgtctgctctgagct

SEQ ID NO: 44519 - DNA, 22 bp, Homo sapiens
gagaaccacgtctgctctgagc

SEQ ID NO: 44520 - DNA, 23 bp, Homo sapiens
tgagaaccacgtctgctctgagc

SEQ ID NO: 44521 - DNA, 20 bp, Homo sapiens
gagaaccacgtctgctctga

SEQ ID NO: 44522 - DNA, 21 bp, Homo sapiens
tgagaaccacgtctgctctga

SEQ ID NO: 44523 - DNA, 20 bp, Homo sapiens
tgagaaccacgtctgctctg

SEQ ID NO: 44524 - DNA, 18 bp, Homo sapiens
tgagaaccacgtctgctc

SEQ ID NO: 44525 - DNA, 24 bp, Homo sapiens
cagttctgctgttctgactctagg

SEQ ID NO: 44526 - DNA, 22 bp, Homo sapiens
cagttctgctgttctgactcta

SEQ ID NO: 44527 - DNA, 21 bp, Homo sapiens
cagttctgctgttctgactct

SEQ ID NO: 44528 - DNA, 20 bp, Homo sapiens
cagttctgctgttctgactc

SEQ ID NO: 44529 - DNA, 19 bp, Homo sapiens
cagttctgctgttctgact

SEQ ID NO: 44530 - DNA, 25 bp, Homo sapiens
atggagctggaaccagatcaggctt

SEQ ID NO: 44531 - DNA, 24 bp, Homo sapiens
atggagctggaaccagatcaggct

SEQ ID NO: 44532 - DNA, 22 bp, Homo sapiens
tggagctggaaccagatcaggc

SEQ ID NO: 44533 - DNA, 24 bp, Homo sapiens
catggagctggaaccagatcaggc

SEQ ID NO: 44534 - DNA, 21 bp, Homo sapiens
tggagctggaaccagatcagg

SEQ ID NO: 44535 - DNA, 22 bp, Homo sapiens
atggagctggaaccagatcagg

SEQ ID NO: 44536 - DNA, 26 bp, Homo sapiens
agccacatggagctggaaccagatca

SEQ ID NO: 44537 - DNA, 18 bp, Homo sapiens
tctggattgaagagacga

SEQ ID NO: 44538 - DNA, 19 bp, Homo sapiens
tctggattgaagagacgac

SEQ ID NO: 44539 - DNA, 20 bp, Homo sapiens
tctggattgaagagacgacc

SEQ ID NO: 44540 - DNA, 21 bp, Homo sapiens
tctggattgaagagacgaccc

SEQ ID NO: 44541 - DNA, 23 bp, Homo sapiens
tctggattgaagagacgacccaa

SEQ ID NO: 44542 - DNA, 25 bp, Homo sapiens
tctggattgaagagacgacccaagc

SEQ ID NO: 44543 - DNA, 22 bp, Homo sapiens
ctggattgaagagacgacccaa

SEQ ID NO: 44544 - DNA, 24 bp, Homo sapiens
ctggattgaagagacgacccaagc

SEQ ID NO: 44545 - DNA, 20 bp, Homo sapiens
tggattgaagagacgaccca

SEQ ID NO: 44546 - DNA, 21 bp, Homo sapiens
tggattgaagagacgacccaa

SEQ ID NO: 44547 - DNA, 22 bp, Homo sapiens
tggattgaagagacgacccaag

SEQ ID NO: 44548 - DNA, 23 bp, Homo sapiens
tggattgaagagacgacccaagc

SEQ ID NO: 44549 - DNA, 20 bp, Homo sapiens
ttgggttttctcttcaatcc

SEQ ID NO: 44550 - DNA, 21 bp, Homo sapiens
ttgggttttctcttcaatcca

SEQ ID NO: 44551 - DNA, 23 bp, Homo sapiens
ttgggttttctcttcaatccaga

SEQ ID NO: 44552 - DNA, 21 bp, Homo sapiens
tgggttttctcttcaatccag

SEQ ID NO: 44553 - DNA, 22 bp, Homo sapiens
tgggttttctcttcaatccaga

SEQ ID NO: 44554 - DNA, 17 bp, Homo sapiens
tcttcaatccagactgt

SEQ ID NO: 44555 - DNA, 18 bp, Homo sapiens
tcttcaatccagactgtg

SEQ ID NO: 44556 - DNA, 23 bp, Homo sapiens
aggaaccagaaaatgagaagttg

SEQ ID NO: 44557 - DNA, 24 bp, Homo sapiens
tgcgacattggaagtagtatcatc

SEQ ID NO: 44558 - DNA, 21 bp, Homo sapiens
tgcgacattggaagtagtatc

SEQ ID NO: 44559 - DNA, 24 bp, Homo sapiens
ccctgcgacattggaagtagtatc

SEQ ID NO: 44560 - DNA, 20 bp, Homo sapiens
tgcgacattggaagtagtat

SEQ ID NO: 44561 - DNA, 19 bp, Homo sapiens
tgcgacattggaagtagta

SEQ ID NO: 44562 - DNA, 20 bp, Homo sapiens
cctgcgacattggaagtagt

SEQ ID NO: 44563 - DNA, 19 bp, Homo sapiens
gaggggctcacatcacccc

SEQ ID NO: 44564 - DNA, 16 bp, Homo sapiens
aggggctcacatcacc

SEQ ID NO: 44565 - DNA, 19 bp, Homo sapiens
gggctcacatcaccccatc

SEQ ID NO: 44566 - DNA, 20 bp, Homo sapiens
gggctcacatcaccccatca

SEQ ID NO: 44567 - DNA, 21 bp, Homo sapiens
gggctcacatcaccccatcaa

SEQ ID NO: 44568 - DNA, 22 bp, Homo sapiens
gggctcacatcaccccatcaaa

SEQ ID NO: 44569 - DNA, 24 bp, Homo sapiens
gggctcacatcaccccatcaaagt

SEQ ID NO: 44570 - DNA, 18 bp, Homo sapiens
ggctcacatcaccccatc

SEQ ID NO: 44571 - DNA, 19 bp, Homo sapiens
ggctcacatcaccccatca

SEQ ID NO: 44572 - DNA, 20 bp, Homo sapiens
ggctcacatcaccccatcaa

SEQ ID NO: 44573 - DNA, 21 bp, Homo sapiens
ggctcacatcaccccatcaaa

SEQ ID NO: 44574 - DNA, 23 bp, Homo sapiens
ggctcacatcaccccatcaaagt

SEQ ID NO: 44575 - DNA, 17 bp, Homo sapiens
gctcacatcaccccatc

SEQ ID NO: 44576 - DNA, 18 bp, Homo sapiens
gctcacatcaccccatca

SEQ ID NO: 44577 - DNA, 22 bp, Homo sapiens
gctcacatcaccccatcaaagt

SEQ ID NO: 44578 - DNA, 17 bp, Homo sapiens
tcacatcaccccatcaa

SEQ ID NO: 44579 - DNA, 16 bp, Homo sapiens
cacatcaccccatcaa

SEQ ID NO: 44580 - DNA, 21 bp, Homo sapiens
tgagcttattcataaaagtgc

SEQ ID NO: 44581 - DNA, 22 bp, Homo sapiens
tgagcttattcataaaagtgca

SEQ ID NO: 44582 - DNA, 23 bp, Homo sapiens
tgagcttattcataaaagtgcag

SEQ ID NO: 44583 - DNA, 27 bp, Homo sapiens
tgagcttattcataaaagtgcagtatg

SEQ ID NO: 44584 - DNA, 19 bp, Homo sapiens
gagcttattcataaaagtg

SEQ ID NO: 44585 - DNA, 20 bp, Homo sapiens
gagcttattcataaaagtgc

SEQ ID NO: 44586 - DNA, 21 bp, Homo sapiens
gagcttattcataaaagtgca

SEQ ID NO: 44587 - DNA, 23 bp, Homo sapiens
gagcttattcataaaagtgcagt

SEQ ID NO: 44588 - DNA, 24 bp, Homo sapiens
gagcttattcataaaagtgcagta

SEQ ID NO: 44589 - DNA, 25 bp, Homo sapiens
gagcttattcataaaagtgcagtat

SEQ ID NO: 44590 - DNA, 26 bp, Homo sapiens
gagcttattcataaaagtgcagtatg

SEQ ID NO: 44591 - DNA, 19 bp, Homo sapiens
gtaattttatgtataagct

SEQ ID NO: 44592 - DNA, 20 bp, Homo sapiens
gtaattttatgtataagcta

SEQ ID NO: 44593 - DNA, 21 bp, Homo sapiens
gtaattttatgtataagctag

SEQ ID NO: 44594 - DNA, 22 bp, Homo sapiens
gtaattttatgtataagctagt

SEQ ID NO: 44595 - DNA, 23 bp, Homo sapiens
gtaattttatgtataagctagtc

SEQ ID NO: 44596 - DNA, 24 bp, Homo sapiens
gtaattttatgtataagctagtct

SEQ ID NO: 44597 - DNA, 25 bp, Homo sapiens
gtaattttatgtataagctagtctc

SEQ ID NO: 44598 - DNA, 19 bp, Homo sapiens
taattttatgtataagcta

SEQ ID NO: 44599 - DNA, 20 bp, Homo sapiens
taattttatgtataagctag

SEQ ID NO: 44600 - DNA, 22 bp, Homo sapiens
taattttatgtataagctagtc

SEQ ID NO: 44601 - DNA, 23 bp, Homo sapiens
taattttatgtataagctagtct

SEQ ID NO: 44602 - DNA, 24 bp, Homo sapiens
taattttatgtataagctagtctc

SEQ ID NO: 44603 - DNA, 27 bp, Homo sapiens
taattttatgtataagctagtctctga

SEQ ID NO: 44604 - DNA, 22 bp, Homo sapiens
cgacggcggggtgggtgaggtc

SEQ ID NO: 44605 - DNA, 21 bp, Homo sapiens
cggcggggtgggtgaggtcgg

SEQ ID NO: 44606 - DNA, 19 bp, Homo sapiens
gcggggtgggtgaggtcgg

SEQ ID NO: 44607 - DNA, 18 bp, Homo sapiens
cggggtgggtgaggtcgg

SEQ ID NO: 44608 - DNA, 19 bp, Homo sapiens
cggggtgggtgaggtcggg

SEQ ID NO: 44609 - DNA, 21 bp, Homo sapiens
cggggtgggtgaggtcgggcc

SEQ ID NO: 44610 - DNA, 22 bp, Homo sapiens
cggggtgggtgaggtcgggccc

SEQ ID NO: 44611 - DNA, 25 bp, Homo sapiens
cggggtgggtgaggtcgggccccaa

SEQ ID NO: 44612 - DNA, 19 bp, Homo sapiens
ggggtgggtgaggtcgggc

SEQ ID NO: 44613 - DNA, 19 bp, Homo sapiens
gggtgggtgaggtcgggcc

SEQ ID NO: 44614 - DNA, 24 bp, Homo sapiens
gggtgggtgaggtcgggccccaag

SEQ ID NO: 44615 - DNA, 22 bp, Homo sapiens
ggtgggtgaggtcgggccccaa

SEQ ID NO: 44616 - DNA, 18 bp, Homo sapiens
tgggtgaggtcgggcccc

SEQ ID NO: 44617 - DNA, 18 bp, Homo sapiens
gtgaggtcgggccccaag

SEQ ID NO: 44618 - DNA, 17 bp, Homo sapiens
tgaggtcgggccccaag

SEQ ID NO: 44619 - DNA, 28 bp, Homo sapiens
tctgggcaacaaagtgagaccttatctc

SEQ ID NO: 44620 - DNA, 27 bp, Homo sapiens
tctgggcaacaaagtgagaccttatct

SEQ ID NO: 44621 - DNA, 26 bp, Homo sapiens
tctgggcaacaaagtgagaccttatc

SEQ ID NO: 44622 - DNA, 25 bp, Homo sapiens
tctgggcaacaaagtgagaccttat

SEQ ID NO: 44623 - DNA, 24 bp, Homo sapiens
tctgggcaacaaagtgagacctta

SEQ ID NO: 44624 - DNA, 25 bp, Homo sapiens
ctggtctgggcaacaaagtgagacc

SEQ ID NO: 44625 - DNA, 22 bp, Homo sapiens
tggtctgggcaacaaagtgaga

SEQ ID NO: 44626 - DNA, 25 bp, Homo sapiens
actggagtttgtttcaatattgcaa

SEQ ID NO: 44627 - DNA, 27 bp, Homo sapiens
ttcactggagtttgtttcaatattgca

SEQ ID NO: 44628 - DNA, 23 bp, Homo sapiens
actggagtttgtttcaatattgc

SEQ ID NO: 44629 - DNA, 22 bp, Homo sapiens
actggagtttgtttcaatattg

SEQ ID NO: 44630 - DNA, 25 bp, Homo sapiens
ttcactggagtttgtttcaatattg

SEQ ID NO: 44631 - DNA, 21 bp, Homo sapiens
actggagtttgtttcaatatt

SEQ ID NO: 44632 - DNA, 23 bp, Homo sapiens
tcactggagtttgtttcaatatt

SEQ ID NO: 44633 - DNA, 24 bp, Homo sapiens
ttcactggagtttgtttcaatatt

SEQ ID NO: 44634 - DNA, 22 bp, Homo sapiens
tcactggagtttgtttcaatat

SEQ ID NO: 44635 - DNA, 23 bp, Homo sapiens
ttcactggagtttgtttcaatat

SEQ ID NO: 44636 - DNA, 21 bp, Homo sapiens
tcactggagtttgtttcaata

SEQ ID NO: 44637 - DNA, 21 bp, Homo sapiens
ttcactggagtttgtttcaat

SEQ ID NO: 44638 - DNA, 24 bp, Homo sapiens
aagttcactggagtttgtttcaat

SEQ ID NO: 44639 - DNA, 20 bp, Homo sapiens
ttcactggagtttgtttcaa

SEQ ID NO: 44640 - DNA, 23 bp, Homo sapiens
tgaaacaatctctactgaaccag

SEQ ID NO: 44641 - DNA, 24 bp, Homo sapiens
ttgaaacaatctctactgaaccag

SEQ ID NO: 44642 - DNA, 23 bp, Homo sapiens
ttgaaacaatctctactgaacca

SEQ ID NO: 44643 - DNA, 21 bp, Homo sapiens
tgaaacaatctctactgaacc

SEQ ID NO: 44644 - DNA, 22 bp, Homo sapiens
ttgaaacaatctctactgaacc

SEQ ID NO: 44645 - DNA, 24 bp, Homo sapiens
tgttgaaacaatctctactgaacc

SEQ ID NO: 44646 - DNA, 21 bp, Homo sapiens
ttgaaacaatctctactgaac

SEQ ID NO: 44647 - DNA, 23 bp, Homo sapiens
tgttgaaacaatctctactgaac

SEQ ID NO: 44648 - DNA, 20 bp, Homo sapiens
ttgaaacaatctctactgaa

SEQ ID NO: 44649 - DNA, 23 bp, Homo sapiens
gtgttgaaacaatctctactgaa

SEQ ID NO: 44650 - DNA, 22 bp, Homo sapiens
gtgttgaaacaatctctactga

SEQ ID NO: 44651 - DNA, 18 bp, Homo sapiens
ttgaaacaatctctactg

SEQ ID NO: 44652 - DNA, 26 bp, Homo sapiens
tgacatcacatatacggcagctaaac

SEQ ID NO: 44653 - DNA, 24 bp, Homo sapiens
tgacatcacatatacggcagctaa

SEQ ID NO: 44654 - DNA, 23 bp, Homo sapiens
tgacatcacatatacggcagcta

SEQ ID NO: 44655 - DNA, 24 bp, Homo sapiens
gtgacatcacatatacggcagcta

SEQ ID NO: 44656 - DNA, 22 bp, Homo sapiens
tgacatcacatatacggcagct

SEQ ID NO: 44657 - DNA, 23 bp, Homo sapiens
gtgacatcacatatacggcagct

SEQ ID NO: 44658 - DNA, 21 bp, Homo sapiens
tgacatcacatatacggcagc

SEQ ID NO: 44659 - DNA, 20 bp, Homo sapiens
tgacatcacatatacggcag

SEQ ID NO: 44660 - DNA, 21 bp, Homo sapiens
gtgacatcacatatacggcag

SEQ ID NO: 44661 - DNA, 20 bp, Homo sapiens
gtgacatcacatatacggca

SEQ ID NO: 44662 - DNA, 19 bp, Homo sapiens
gtgacatcacatatacggc

SEQ ID NO: 44663 - DNA, 17 bp, Homo sapiens
gtgacatcacatatacg

SEQ ID NO: 44664 - DNA, 23 bp, Homo sapiens
ggtcgtatgtgtgacgccattta

SEQ ID NO: 44665 - DNA, 21 bp, Homo sapiens
ggtcgtatgtgtgacgccatt

SEQ ID NO: 44666 - DNA, 22 bp, Homo sapiens
tggtcgtatgtgtgacgccatt

SEQ ID NO: 44667 - DNA, 20 bp, Homo sapiens
ggtcgtatgtgtgacgccat

SEQ ID NO: 44668 - DNA, 17 bp, Homo sapiens
ggtcgtatgtgtgacgc

SEQ ID NO: 44669 - DNA, 21 bp, Homo sapiens
acgaggggactggttaataga

SEQ ID NO: 44670 - DNA, 20 bp, Homo sapiens
aggggactggttaatagaac

SEQ ID NO: 44671 - DNA, 21 bp, Homo sapiens
aggggactggttaatagaact

SEQ ID NO: 44672 - DNA, 24 bp, Homo sapiens
aggggactggttaatagaactaac

SEQ ID NO: 44673 - DNA, 20 bp, Homo sapiens
ggggactggttaatagaact

SEQ ID NO: 44674 - DNA, 22 bp, Homo sapiens
tgttctgttaacccatcccctc

SEQ ID NO: 44675 - DNA, 21 bp, Homo sapiens
gttctgttaacccatcccctc

SEQ ID NO: 44676 - DNA, 23 bp, Homo sapiens
gttctgttaacccatcccctcat

SEQ ID NO: 44677 - DNA, 20 bp, Homo sapiens
tctgttaacccatcccctca

SEQ ID NO: 44678 - DNA, 21 bp, Homo sapiens
tctgttaacccatcccctcat

SEQ ID NO: 44679 - DNA, 24 bp, Homo sapiens
tctgttaacccatcccctcatcta

SEQ ID NO: 44680 - DNA, 16 bp, Homo sapiens
tgaggtagaccatggg

SEQ ID NO: 44681 - DNA, 23 bp, Homo sapiens
taggaataatatcacagtaggtg

SEQ ID NO: 44682 - DNA, 22 bp, Homo sapiens
taggaataatatcacagtaggt

SEQ ID NO: 44683 - DNA, 21 bp, Homo sapiens
taggaataatatcacagtagg

SEQ ID NO: 44684 - DNA, 25 bp, Homo sapiens
aagcaaagtgatgagtaatactggc

SEQ ID NO: 44685 - DNA, 19 bp, Homo sapiens
gcaaagtgatgagtaatac

SEQ ID NO: 44686 - DNA, 20 bp, Homo sapiens
gcaaagtgatgagtaatact

SEQ ID NO: 44687 - DNA, 21 bp, Homo sapiens
gcaaagtgatgagtaatactg

SEQ ID NO: 44688 - DNA, 22 bp, Homo sapiens
gcaaagtgatgagtaatactgg

SEQ ID NO: 44689 - DNA, 23 bp, Homo sapiens
gcaaagtgatgagtaatactggc

SEQ ID NO: 44690 - DNA, 24 bp, Homo sapiens
gcaaagtgatgagtaatactggct

SEQ ID NO: 44691 - DNA, 25 bp, Homo sapiens
gcaaagtgatgagtaatactggctg

SEQ ID NO: 44692 - DNA, 26 bp, Homo sapiens
gcaaagtgatgagtaatactggctgg

SEQ ID NO: 44693 - DNA, 27 bp, Homo sapiens
gcaaagtgatgagtaatactggctgga

SEQ ID NO: 44694 - DNA, 28 bp, Homo sapiens
gcaaagtgatgagtaatactggctggag

SEQ ID NO: 44695 - DNA, 18 bp, Homo sapiens
caaagtgatgagtaatac

SEQ ID NO: 44696 - DNA, 19 bp, Homo sapiens
caaagtgatgagtaatact

SEQ ID NO: 44697 - DNA, 20 bp, Homo sapiens
caaagtgatgagtaatactg

SEQ ID NO: 44698 - DNA, 21 bp, Homo sapiens
caaagtgatgagtaatactgg

SEQ ID NO: 44699 - DNA, 22 bp, Homo sapiens
caaagtgatgagtaatactggc

SEQ ID NO: 44700 - DNA, 23 bp, Homo sapiens
caaagtgatgagtaatactggct

SEQ ID NO: 44701 - DNA, 25 bp, Homo sapiens
caaagtgatgagtaatactggctgg

SEQ ID NO: 44702 - DNA, 26 bp, Homo sapiens
caaagtgatgagtaatactggctgga

SEQ ID NO: 44703 - DNA, 27 bp, Homo sapiens
caaagtgatgagtaatactggctggag

SEQ ID NO: 44704 - DNA, 28 bp, Homo sapiens
caaagtgatgagtaatactggctggagc

SEQ ID NO: 44705 - DNA, 20 bp, Homo sapiens
aaagtgatgagtaatactgg

SEQ ID NO: 44706 - DNA, 23 bp, Homo sapiens
cattgcacttgtctcggtctgac

SEQ ID NO: 44707 - DNA, 21 bp, Homo sapiens
cattgcacttgtctcggtctg

SEQ ID NO: 44708 - DNA, 20 bp, Homo sapiens
cattgcacttgtctcggtct

SEQ ID NO: 44709 - DNA, 19 bp, Homo sapiens
cattgcacttgtctcggtc

SEQ ID NO: 44710 - DNA, 17 bp, Homo sapiens
cattgcacttgtctcgg

SEQ ID NO: 44711 - DNA, 25 bp, Homo sapiens
aggcggagacttgggcaattgctgg

SEQ ID NO: 44712 - DNA, 24 bp, Homo sapiens
aggcggagacttgggcaattgctg

SEQ ID NO: 44713 - DNA, 23 bp, Homo sapiens
aggcggagacttgggcaattgct

SEQ ID NO: 44714 - DNA, 22 bp, Homo sapiens
aggcggagacttgggcaattgc

SEQ ID NO: 44715 - DNA, 20 bp, Homo sapiens
aggcggagacttgggcaatt

SEQ ID NO: 44716 - DNA, 19 bp, Homo sapiens
aggcggagacttgggcaat

SEQ ID NO: 44717 - DNA, 17 bp, Homo sapiens
aggcggagacttgggca

SEQ ID NO: 44718 - DNA, 16 bp, Homo sapiens
aggcggagacttgggc

SEQ ID NO: 44719 - DNA, 21 bp, Homo sapiens
ctgagctagcacttcccgagc

SEQ ID NO: 44720 - DNA, 24 bp, Homo sapiens
ctgctgagctagcacttcccgagc

SEQ ID NO: 44721 - DNA, 25 bp, Homo sapiens
actgctgagctagcacttcccgagc

SEQ ID NO: 44722 - DNA, 24 bp, Homo sapiens
actgctgagctagcacttcccgag

SEQ ID NO: 44723 - DNA, 22 bp, Homo sapiens
ctgctgagctagcacttcccga

SEQ ID NO: 44724 - DNA, 23 bp, Homo sapiens
actgctgagctagcacttcccga

SEQ ID NO: 44725 - DNA, 21 bp, Homo sapiens
actgctgagctagcacttccc

SEQ ID NO: 44726 - DNA, 20 bp, Homo sapiens
actgctgagctagcacttcc

SEQ ID NO: 44727 - DNA, 21 bp, Homo sapiens
tactgctgagctagcacttcc

SEQ ID NO: 44728 - DNA, 19 bp, Homo sapiens
actgctgagctagcacttc

SEQ ID NO: 44729 - DNA, 18 bp, Homo sapiens
actgctgagctagcactt

SEQ ID NO: 44730 - DNA, 17 bp, Homo sapiens
caacctactgctgagct

SEQ ID NO: 44731 - DNA, 28 bp, Homo sapiens
caaagtgctgttcgtgcaggtagtgtga

SEQ ID NO: 44732 - DNA, 25 bp, Homo sapiens
caaagtgctgttcgtgcaggtagtg

SEQ ID NO: 44733 - DNA, 24 bp, Homo sapiens
caaagtgctgttcgtgcaggtagt

SEQ ID NO: 44734 - DNA, 22 bp, Homo sapiens
caaagtgctgttcgtgcaggta

SEQ ID NO: 44735 - DNA, 21 bp, Homo sapiens
caaagtgctgttcgtgcaggt

SEQ ID NO: 44736 - DNA, 20 bp, Homo sapiens
caaagtgctgttcgtgcagg

SEQ ID NO: 44737 - DNA, 19 bp, Homo sapiens
caaagtgctgttcgtgcag

SEQ ID NO: 44738 - DNA, 17 bp, Homo sapiens
caaagtgctgttcgtgc

SEQ ID NO: 44739 - DNA, 27 bp, Homo sapiens
ccgcactgtgggtacttgctgctccag

SEQ ID NO: 44740 - DNA, 25 bp, Homo sapiens
ccgcactgtgggtacttgctgctcc

SEQ ID NO: 44741 - DNA, 24 bp, Homo sapiens
ccgcactgtgggtacttgctgctc

SEQ ID NO: 44742 - DNA, 25 bp, Homo sapiens
accgcactgtgggtacttgctgctc

SEQ ID NO: 44743 - DNA, 26 bp, Homo sapiens
taccgcactgtgggtacttgctgctc

SEQ ID NO: 44744 - DNA, 23 bp, Homo sapiens
ccgcactgtgggtacttgctgct

SEQ ID NO: 44745 - DNA, 21 bp, Homo sapiens
ccgcactgtgggtacttgctg

SEQ ID NO: 44746 - DNA, 20 bp, Homo sapiens
ccgcactgtgggtacttgct

SEQ ID NO: 44747 - DNA, 22 bp, Homo sapiens
taccgcactgtgggtacttgct

SEQ ID NO: 44748 - DNA, 21 bp, Homo sapiens
taccgcactgtgggtacttgc

SEQ ID NO: 44749 - DNA, 17 bp, Homo sapiens
ccgcactgtgggtactt

SEQ ID NO: 44750 - DNA, 27 bp, Homo sapiens
taaagtgctgacagtgcagatagtggt

SEQ ID NO: 44751 - DNA, 25 bp, Homo sapiens
taaagtgctgacagtgcagatagtg

SEQ ID NO: 44752 - DNA, 24 bp, Homo sapiens
taaagtgctgacagtgcagatagt

SEQ ID NO: 44753 - DNA, 23 bp, Homo sapiens
taaagtgctgacagtgcagatag

SEQ ID NO: 44754 - DNA, 22 bp, Homo sapiens
taaagtgctgacagtgcagata

SEQ ID NO: 44755 - DNA, 20 bp, Homo sapiens
taaagtgctgacagtgcaga

SEQ ID NO: 44756 - DNA, 25 bp, Homo sapiens
gtgtggatcctggaggaatcgtggc

SEQ ID NO: 44757 - DNA, 22 bp, Homo sapiens
tgtggatcctggaggaatcgtg

SEQ ID NO: 44758 - DNA, 27 bp, Homo sapiens
gtgagtgtggatcctggaggaatcgtg

SEQ ID NO: 44759 - DNA, 24 bp, Homo sapiens
tgagtgtggatcctggaggaatcg

SEQ ID NO: 44760 - DNA, 25 bp, Homo sapiens
gtgagtgtggatcctggaggaatcg

SEQ ID NO: 44761 - DNA, 24 bp, Homo sapiens
gtgagtgtggatcctggaggaatc

SEQ ID NO: 44762 - DNA, 22 bp, Homo sapiens
gtgagtgtggatcctggaggaa

SEQ ID NO: 44763 - DNA, 21 bp, Homo sapiens
gtgagtgtggatcctggagga

SEQ ID NO: 44764 - DNA, 20 bp, Homo sapiens
gtgagtgtggatcctggagg

SEQ ID NO: 44765 - DNA, 21 bp, Homo sapiens
accacccccgggcaaagacct

SEQ ID NO: 44766 - DNA, 22 bp, Homo sapiens
accacccccgggcaaagacctg

SEQ ID NO: 44767 - DNA, 23 bp, Homo sapiens
accacccccgggcaaagacctgc

SEQ ID NO: 44768 - DNA, 25 bp, Homo sapiens
accacccccgggcaaagacctgcag

SEQ ID NO: 44769 - DNA, 20 bp, Homo sapiens
cacccccgggcaaagacctg

SEQ ID NO: 44770 - DNA, 22 bp, Homo sapiens
cacccccgggcaaagacctgca

SEQ ID NO: 44771 - DNA, 23 bp, Homo sapiens
cacccccgggcaaagacctgcag

SEQ ID NO: 44772 - DNA, 24 bp, Homo sapiens
cacccccgggcaaagacctgcaga

SEQ ID NO: 44773 - DNA, 25 bp, Homo sapiens
cacccccgggcaaagacctgcagat

SEQ ID NO: 44774 - DNA, 26 bp, Homo sapiens
cacccccgggcaaagacctgcagatc

SEQ ID NO: 44775 - DNA, 18 bp, Homo sapiens
acccccgggcaaagacct

SEQ ID NO: 44776 - DNA, 21 bp, Homo sapiens
acccccgggcaaagacctgca

SEQ ID NO: 44777 - DNA, 22 bp, Homo sapiens
acccccgggcaaagacctgcag

SEQ ID NO: 44778 - DNA, 23 bp, Homo sapiens
acccccgggcaaagacctgcaga

SEQ ID NO: 44779 - DNA, 25 bp, Homo sapiens
acccccgggcaaagacctgcagatc

SEQ ID NO: 44780 - DNA, 27 bp, Homo sapiens
acccccgggcaaagacctgcagatccc

SEQ ID NO: 44781 - DNA, 21 bp, Homo sapiens
cccccgggcaaagacctgcag

SEQ ID NO: 44782 - DNA, 23 bp, Homo sapiens
cccccgggcaaagacctgcagat

SEQ ID NO: 44783 - DNA, 18 bp, Homo sapiens
ccccgggcaaagacctgc

SEQ ID NO: 44784 - DNA, 23 bp, Homo sapiens
gacgggcccaggactttgtgcgg

SEQ ID NO: 44785 - DNA, 19 bp, Homo sapiens
gcccaggactttgtgcggg

SEQ ID NO: 44786 - DNA, 20 bp, Homo sapiens
gcccaggactttgtgcgggg

SEQ ID NO: 44787 - DNA, 21 bp, Homo sapiens
gcccaggactttgtgcggggt

SEQ ID NO: 44788 - DNA, 23 bp, Homo sapiens
gcccaggactttgtgcggggtgc

SEQ ID NO: 44789 - DNA, 24 bp, Homo sapiens
gcccaggactttgtgcggggtgcc

SEQ ID NO: 44790 - DNA, 25 bp, Homo sapiens
gcccaggactttgtgcggggtgccc

SEQ ID NO: 44791 - DNA, 23 bp, Homo sapiens
cccaggactttgtgcggggtgcc

SEQ ID NO: 44792 - DNA, 20 bp, Homo sapiens
caggactttgtgcggggtgc

SEQ ID NO: 44793 - DNA, 22 bp, Homo sapiens
tgtcagtttatcaaacccatac

SEQ ID NO: 44794 - DNA, 22 bp, Homo sapiens
tgtgtcagtttatcaaacccat

SEQ ID NO: 44795 - DNA, 23 bp, Homo sapiens
ttgtgtcagtttatcaaacccat

SEQ ID NO: 44796 - DNA, 24 bp, Homo sapiens
gttgtgtcagtttatcaaacccat

SEQ ID NO: 44797 - DNA, 19 bp, Homo sapiens
tgtcagtttatcaaaccca

SEQ ID NO: 44798 - DNA, 22 bp, Homo sapiens
ttgtgtcagtttatcaaaccca

SEQ ID NO: 44799 - DNA, 23 bp, Homo sapiens
gttgtgtcagtttatcaaaccca

SEQ ID NO: 44800 - DNA, 18 bp, Homo sapiens
tgtcagtttatcaaaccc

SEQ ID NO: 44801 - DNA, 22 bp, Homo sapiens
gttgtgtcagtttatcaaaccc

SEQ ID NO: 44802 - DNA, 20 bp, Homo sapiens
ttgtgtcagtttatcaaacc

SEQ ID NO: 44803 - DNA, 21 bp, Homo sapiens
gttgtgtcagtttatcaaacc

SEQ ID NO: 44804 - DNA, 25 bp, Homo sapiens
cctggaaacactgaggttgtgtctc

SEQ ID NO: 44805 - DNA, 22 bp, Homo sapiens
cctggaaacactgaggttgtgt

SEQ ID NO: 44806 - DNA, 19 bp, Homo sapiens
cctggaaacactgaggttg

SEQ ID NO: 44807 - DNA, 28 bp, Homo sapiens
tatacctcagttttatcaggtgttctta

SEQ ID NO: 44808 - DNA, 23 bp, Homo sapiens
tatacctcagttttatcaggtgt

SEQ ID NO: 44809 - DNA, 24 bp, Homo sapiens
ctatacctcagttttatcaggtgt

SEQ ID NO: 44810 - DNA, 21 bp, Homo sapiens
tatacctcagttttatcaggt

SEQ ID NO: 44811 - DNA, 20 bp, Homo sapiens
tatacctcagttttatcagg

SEQ ID NO: 44812 - DNA, 22 bp, Homo sapiens
cgacaaagcaagactctttctt

SEQ ID NO: 44813 - DNA, 26 bp, Homo sapiens
tgggcgacaaagcaagactctttctt

SEQ ID NO: 44814 - DNA, 27 bp, Homo sapiens
ctgggcgacaaagcaagactctttctt

SEQ ID NO: 44815 - DNA, 20 bp, Homo sapiens
atgggaacttagtagaggtt

SEQ ID NO: 44816 - DNA, 21 bp, Homo sapiens
atgggaacttagtagaggttt

SEQ ID NO: 44817 - DNA, 21 bp, Homo sapiens
tgggaacttagtagaggttta

SEQ ID NO: 44818 - DNA, 23 bp, Homo sapiens
tgggaacttagtagaggtttaag

SEQ ID NO: 44819 - DNA, 23 bp, Homo sapiens
agctcagaatgtcagttctgttt

SEQ ID NO: 44820 - DNA, 26 bp, Homo sapiens
aatagctcagaatgtcagttctgttt

SEQ ID NO: 44821 - DNA, 24 bp, Homo sapiens
atagctcagaatgtcagttctgtt

SEQ ID NO: 44822 - DNA, 21 bp, Homo sapiens
agctcagaatgtcagttctgt

SEQ ID NO: 44823 - DNA, 23 bp, Homo sapiens
atagctcagaatgtcagttctgt

SEQ ID NO: 44824 - DNA, 24 bp, Homo sapiens
aatagctcagaatgtcagttctgt

SEQ ID NO: 44825 - DNA, 22 bp, Homo sapiens
atagctcagaatgtcagttctg

SEQ ID NO: 44826 - DNA, 27 bp, Homo sapiens
gtggaatagctcagaatgtcagttctg

SEQ ID NO: 44827 - DNA, 21 bp, Homo sapiens
atagctcagaatgtcagttct

SEQ ID NO: 44828 - DNA, 22 bp, Homo sapiens
aatagctcagaatgtcagttct

SEQ ID NO: 44829 - DNA, 25 bp, Homo sapiens
tggaatagctcagaatgtcagttct

SEQ ID NO: 44830 - DNA, 28 bp, Homo sapiens
ctgtggaatagctcagaatgtcagttct

SEQ ID NO: 44831 - DNA, 20 bp, Homo sapiens
atagctcagaatgtcagttc

SEQ ID NO: 44832 - DNA, 21 bp, Homo sapiens
aatagctcagaatgtcagttc

SEQ ID NO: 44833 - DNA, 18 bp, Homo sapiens
tagctcagaatgtcagtt

SEQ ID NO: 44834 - DNA, 19 bp, Homo sapiens
atagctcagaatgtcagtt

SEQ ID NO: 44835 - DNA, 20 bp, Homo sapiens
aatagctcagaatgtcagtt

SEQ ID NO: 44836 - DNA, 19 bp, Homo sapiens
aatagctcagaatgtcagt

SEQ ID NO: 44837 - DNA, 17 bp, Homo sapiens
atagctcagaatgtcag

SEQ ID NO: 44838 - DNA, 18 bp, Homo sapiens
aatagctcagaatgtcag

SEQ ID NO: 44839 - DNA, 20 bp, Homo sapiens
ctgtggaatagctcagaatg

SEQ ID NO: 44840 - DNA, 16 bp, Homo sapiens
ctgtggaatagctcag

SEQ ID NO: 44841 - DNA, 22 bp, Homo sapiens
aggaggagaaatgctggactaa

SEQ ID NO: 44842 - DNA, 23 bp, Homo sapiens
aggagaaatgctggactaatctg

SEQ ID NO: 44843 - DNA, 24 bp, Homo sapiens
aggagaaatgctggactaatctgc

SEQ ID NO: 44844 - DNA, 19 bp, Homo sapiens
gagaaatgctggactaatc

SEQ ID NO: 44845 - DNA, 21 bp, Homo sapiens
gagaaatgctggactaatctg

SEQ ID NO: 44846 - DNA, 23 bp, Homo sapiens
gagaaatgctggactaatctgct

SEQ ID NO: 44847 - DNA, 24 bp, Homo sapiens
gagaaatgctggactaatctgcta

SEQ ID NO: 44848 - DNA, 26 bp, Homo sapiens
gagaaatgctggactaatctgctaat

SEQ ID NO: 44849 - DNA, 27 bp, Homo sapiens
gagaaatgctggactaatctgctaatc

SEQ ID NO: 44850 - DNA, 20 bp, Homo sapiens
agaaatgctggactaatctg

SEQ ID NO: 44851 - DNA, 21 bp, Homo sapiens
agaaatgctggactaatctgc

SEQ ID NO: 44852 - DNA, 22 bp, Homo sapiens
agaaatgctggactaatctgct

SEQ ID NO: 44853 - DNA, 26 bp, Homo sapiens
agaaatgctggactaatctgctaatc

SEQ ID NO: 44854 - DNA, 19 bp, Homo sapiens
aaatgctggactaatctgc

SEQ ID NO: 44855 - DNA, 22 bp, Homo sapiens
aatgctggactaatctgctaat

SEQ ID NO: 44856 - DNA, 23 bp, Homo sapiens
aatgctggactaatctgctaatc

SEQ ID NO: 44857 - DNA, 19 bp, Homo sapiens
tggactaatctgctaatcc

SEQ ID NO: 44858 - DNA, 21 bp, Homo sapiens
gggtggggcaatgggatcagg

SEQ ID NO: 44859 - DNA, 22 bp, Homo sapiens
ggtggggcaatgggatcaggtg

SEQ ID NO: 44860 - DNA, 23 bp, Homo sapiens
ggtggggcaatgggatcaggtgc

SEQ ID NO: 44861 - DNA, 24 bp, Homo sapiens
ggtggggcaatgggatcaggtgcc

SEQ ID NO: 44862 - DNA, 19 bp, Homo sapiens
gtggggcaatgggatcagg

SEQ ID NO: 44863 - DNA, 20 bp, Homo sapiens
gtggggcaatgggatcaggt

SEQ ID NO: 44864 - DNA, 21 bp, Homo sapiens
gtggggcaatgggatcaggtg

SEQ ID NO: 44865 - DNA, 22 bp, Homo sapiens
gtggggcaatgggatcaggtgc

SEQ ID NO: 44866 - DNA, 21 bp, Homo sapiens
caccccactcctggtaccata

SEQ ID NO: 44867 - DNA, 20 bp, Homo sapiens
accccactcctggtaccata

SEQ ID NO: 44868 - DNA, 21 bp, Homo sapiens
accccactcctggtaccatag

SEQ ID NO: 44869 - DNA, 22 bp, Homo sapiens
accccactcctggtaccatagt

SEQ ID NO: 44870 - DNA, 23 bp, Homo sapiens
accccactcctggtaccatagtc

SEQ ID NO: 44871 - DNA, 20 bp, Homo sapiens
ccccactcctggtaccatag

SEQ ID NO: 44872 - DNA, 22 bp, Homo sapiens
tggcaattacttttgcaccaac

SEQ ID NO: 44873 - DNA, 25 bp, Homo sapiens
aaaagtaattgcgagttttaccatt

SEQ ID NO: 44874 - DNA, 22 bp, Homo sapiens
aagtaattgcgagttttaccat

SEQ ID NO: 44875 - DNA, 23 bp, Homo sapiens
aaaagtaattgcgagttttacca

SEQ ID NO: 44876 - DNA, 21 bp, Homo sapiens
aaaagtaattgcgagttttac

SEQ ID NO: 44877 - DNA, 20 bp, Homo sapiens
aaaagtaattgcgagtttta

SEQ ID NO: 44878 - DNA, 24 bp, Homo sapiens
cggtgcaaaagtaattgcgagttt

SEQ ID NO: 44879 - DNA, 22 bp, Homo sapiens
cggtgcaaaagtaattgcgagt

SEQ ID NO: 44880 - DNA, 25 bp, Homo sapiens
aagcgtgatgatgctgctgatgctg

SEQ ID NO: 44881 - DNA, 22 bp, Homo sapiens
aagcgtgatgatgctgctgatg

SEQ ID NO: 44882 - DNA, 20 bp, Homo sapiens
aagcgtgatgatgctgctga

SEQ ID NO: 44883 - DNA, 27 bp, Homo sapiens
tacgtcatcgttgtcatcgtcatcatc

SEQ ID NO: 44884 - DNA, 24 bp, Homo sapiens
acgtcatcgttgtcatcgtcatca

SEQ ID NO: 44885 - DNA, 24 bp, Homo sapiens
tacgtcatcgttgtcatcgtcatc

SEQ ID NO: 44886 - DNA, 23 bp, Homo sapiens
tacgtcatcgttgtcatcgtcat

SEQ ID NO: 44887 - DNA, 21 bp, Homo sapiens
acgtcatcgttgtcatcgtca

SEQ ID NO: 44888 - DNA, 21 bp, Homo sapiens
tacgtcatcgttgtcatcgtc

SEQ ID NO: 44889 - DNA, 20 bp, Homo sapiens
tacgtcatcgttgtcatcgt

SEQ ID NO: 44890 - DNA, 19 bp, Homo sapiens
tacgtcatcgttgtcatcg

SEQ ID NO: 44891 - DNA, 18 bp, Homo sapiens
tacgtcatcgttgtcatc

SEQ ID NO: 44892 - DNA, 16 bp, Homo sapiens
tacgtcatcgttgtca

SEQ ID NO: 44893 - DNA, 26 bp, Homo sapiens
gcggtgatcccgatggtgtgagctgg

SEQ ID NO: 44894 - DNA, 25 bp, Homo sapiens
gcggtgatcccgatggtgtgagctg

SEQ ID NO: 44895 - DNA, 24 bp, Homo sapiens
gcggtgatcccgatggtgtgagct

SEQ ID NO: 44896 - DNA, 22 bp, Homo sapiens
gcggtgatcccgatggtgtgag

SEQ ID NO: 44897 - DNA, 21 bp, Homo sapiens
gcggtgatcccgatggtgtga

SEQ ID NO: 44898 - DNA, 20 bp, Homo sapiens
gcggtgatcccgatggtgtg

SEQ ID NO: 44899 - DNA, 18 bp, Homo sapiens
gcggtgatcccgatggtg

SEQ ID NO: 44900 - DNA, 17 bp, Homo sapiens
aggaggcgccggctgtg

SEQ ID NO: 44901 - DNA, 18 bp, Homo sapiens
aaggaggcgccggctgtg

SEQ ID NO: 44902 - DNA, 19 bp, Homo sapiens
aaaggaggcgccggctgtg

SEQ ID NO: 44903 - DNA, 22 bp, Homo sapiens
cggaaaggaggcgccggctgtg

SEQ ID NO: 44904 - DNA, 20 bp, Homo sapiens
cggaaaggaggcgccggctg

SEQ ID NO: 44905 - DNA, 22 bp, Homo sapiens
atcggaaaggaggcgccggctg

SEQ ID NO: 44906 - DNA, 18 bp, Homo sapiens
ggaaaggaggcgccggct

SEQ ID NO: 44907 - DNA, 23 bp, Homo sapiens
gaatcggaaaggaggcgccggct

SEQ ID NO: 44908 - DNA, 19 bp, Homo sapiens
atcggaaaggaggcgccgg

SEQ ID NO: 44909 - DNA, 20 bp, Homo sapiens
aatcggaaaggaggcgccgg

SEQ ID NO: 44910 - DNA, 21 bp, Homo sapiens
gaatcggaaaggaggcgccgg

SEQ ID NO: 44911 - DNA, 17 bp, Homo sapiens
atcggaaaggaggcgcc

SEQ ID NO: 44912 - DNA, 18 bp, Homo sapiens
aatcggaaaggaggcgcc

SEQ ID NO: 44913 - DNA, 19 bp, Homo sapiens
gaatcggaaaggaggcgcc

SEQ ID NO: 44914 - DNA, 20 bp, Homo sapiens
tgaatcggaaaggaggcgcc

SEQ ID NO: 44915 - DNA, 21 bp, Homo sapiens
gtgaatcggaaaggaggcgcc

SEQ ID NO: 44916 - DNA, 19 bp, Homo sapiens
tgaatcggaaaggaggcgc

SEQ ID NO: 44917 - DNA, 18 bp, Homo sapiens
tgaatcggaaaggaggcg

SEQ ID NO: 44918 - DNA, 21 bp, Homo sapiens
gagtgaatcggaaaggaggcg

SEQ ID NO: 44919 - DNA, 16 bp, Homo sapiens
gaatcggaaaggaggc

SEQ ID NO: 44920 - DNA, 18 bp, Homo sapiens
gtgaatcggaaaggaggc

SEQ ID NO: 44921 - DNA, 19 bp, Homo sapiens
agtgaatcggaaaggaggc

SEQ ID NO: 44922 - DNA, 20 bp, Homo sapiens
gagtgaatcggaaaggaggc

SEQ ID NO: 44923 - DNA, 22 bp, Homo sapiens
ttgagtgaatcggaaaggaggc

SEQ ID NO: 44924 - DNA, 17 bp, Homo sapiens
gtgaatcggaaaggagg

SEQ ID NO: 44925 - DNA, 19 bp, Homo sapiens
gagtgaatcggaaaggagg

SEQ ID NO: 44926 - DNA, 20 bp, Homo sapiens
tgagtgaatcggaaaggagg

SEQ ID NO: 44927 - DNA, 21 bp, Homo sapiens
ttgagtgaatcggaaaggagg

SEQ ID NO: 44928 - DNA, 18 bp, Homo sapiens
gagtgaatcggaaaggag

SEQ ID NO: 44929 - DNA, 20 bp, Homo sapiens
ttgagtgaatcggaaaggag

SEQ ID NO: 44930 - DNA, 19 bp, Homo sapiens
atggacgtgcagtggcatc

SEQ ID NO: 44931 - DNA, 26 bp, Homo sapiens
agctgagctccatggacgtgcagtgg

SEQ ID NO: 44932 - DNA, 25 bp, Homo sapiens
agctgagctccatggacgtgcagtg

SEQ ID NO: 44933 - DNA, 23 bp, Homo sapiens
agctgagctccatggacgtgcag

SEQ ID NO: 44934 - DNA, 19 bp, Homo sapiens
tggtggagctgagctccat

SEQ ID NO: 44935 - DNA, 26 bp, Homo sapiens
aaaaccacagtttcttttgcaccaga

SEQ ID NO: 44936 - DNA, 22 bp, Homo sapiens
gtaattgtggtttttgcctgta

SEQ ID NO: 44937 - DNA, 23 bp, Homo sapiens
ttctttgtttttaattcacagac

SEQ ID NO: 44938 - DNA, 21 bp, Homo sapiens
tctttgtttttaattcacaga

SEQ ID NO: 44939 - DNA, 22 bp, Homo sapiens
ttctttgtttttaattcacaga

SEQ ID NO: 44940 - DNA, 23 bp, Homo sapiens
gttctttgtttttaattcacaga

SEQ ID NO: 44941 - DNA, 20 bp, Homo sapiens
ttctttgtttttaattcaca

SEQ ID NO: 44942 - DNA, 21 bp, Homo sapiens
gttctttgtttttaattcaca

SEQ ID NO: 44943 - DNA, 24 bp, Homo sapiens
taaaagttctttgtttttaattca

SEQ ID NO: 44944 - DNA, 23 bp, Homo sapiens
aaagatggacaattggctaaata

SEQ ID NO: 44945 - DNA, 21 bp, Homo sapiens
aaagatggacaattggctaaa

SEQ ID NO: 44946 - DNA, 18 bp, Homo sapiens
ttagccaattgtccatct

SEQ ID NO: 44947 - DNA, 19 bp, Homo sapiens
ttagccaattgtccatctt

SEQ ID NO: 44948 - DNA, 20 bp, Homo sapiens
ttagccaattgtccatcttt

SEQ ID NO: 44949 - DNA, 21 bp, Homo sapiens
ttagccaattgtccatcttta

SEQ ID NO: 44950 - DNA, 23 bp, Homo sapiens
ttagccaattgtccatctttagc

SEQ ID NO: 44951 - DNA, 24 bp, Homo sapiens
ttagccaattgtccatctttagct

SEQ ID NO: 44952 - DNA, 25 bp, Homo sapiens
ttagccaattgtccatctttagcta

SEQ ID NO: 44953 - DNA, 22 bp, Homo sapiens
taaagatagacaattggctaaa

SEQ ID NO: 44954 - DNA, 19 bp, Homo sapiens
aaagatagacaattggcta

SEQ ID NO: 44955 - DNA, 20 bp, Homo sapiens
aaagatagacaattggctaa

SEQ ID NO: 44956 - DNA, 23 bp, Homo sapiens
aaagatagacaattggctaaata

SEQ ID NO: 44957 - DNA, 26 bp, Homo sapiens
aaagatagacaattggctaaatagaa

SEQ ID NO: 44958 - DNA, 21 bp, Homo sapiens
aagatagacaattggctaaat

SEQ ID NO: 44959 - DNA, 16 bp, Homo sapiens
cggagctggccaaaaa

SEQ ID NO: 44960 - DNA, 18 bp, Homo sapiens
cggagctggccaaaaagc

SEQ ID NO: 44961 - DNA, 19 bp, Homo sapiens
cggagctggccaaaaagca

SEQ ID NO: 44962 - DNA, 20 bp, Homo sapiens
cggagctggccaaaaagcag

SEQ ID NO: 44963 - DNA, 21 bp, Homo sapiens
cggagctggccaaaaagcagg

SEQ ID NO: 44964 - DNA, 22 bp, Homo sapiens
cggagctggccaaaaagcaggc

SEQ ID NO: 44965 - DNA, 23 bp, Homo sapiens
cggagctggccaaaaagcaggca

SEQ ID NO: 44966 - DNA, 24 bp, Homo sapiens
cggagctggccaaaaagcaggcag

SEQ ID NO: 44967 - DNA, 22 bp, Homo sapiens
agctggccaaaaagcaggcaga

SEQ ID NO: 44968 - DNA, 23 bp, Homo sapiens
tggccaaaaagcaggcagagacg

SEQ ID NO: 44969 - DNA, 17 bp, Homo sapiens
gcaggcagagactttaa

SEQ ID NO: 44970 - DNA, 23 bp, Homo sapiens
tggccaaaaagcaggcagagact

SEQ ID NO: 44971 - DNA, 22 bp, Homo sapiens
tggagctggccaaaaagcaggc

SEQ ID NO: 44972 - DNA, 16 bp, Homo sapiens
gaaacctcgtggcctg

SEQ ID NO: 44973 - DNA, 21 bp, Homo sapiens
gaaacctcgtggcctggtctc

SEQ ID NO: 44974 - DNA, 22 bp, Homo sapiens
gaaacctcgtggcctggtctcc

SEQ ID NO: 44975 - DNA, 16 bp, Homo sapiens
ctcgtggcctggtctc

SEQ ID NO: 44976 - DNA, 16 bp, Homo sapiens
tcgtggcctggtctcc

SEQ ID NO: 44977 - DNA, 26 bp, Homo sapiens
cgtggcctggtctccattatttgaga

SEQ ID NO: 44978 - DNA, 16 bp, Homo sapiens
aaggcctctgcagggt

SEQ ID NO: 44979 - DNA, 21 bp, Homo sapiens
aaggcctctgcagggtttgct

SEQ ID NO: 44980 - DNA, 22 bp, Homo sapiens
aaggcctctgcagggtttgctt

SEQ ID NO: 44981 - DNA, 22 bp, Homo sapiens
tatcagtgttcatgtagatgtt

SEQ ID NO: 44982 - DNA, 26 bp, Homo sapiens
tcagtgttcatgtagatgtttaagct

SEQ ID NO: 44983 - DNA, 27 bp, Homo sapiens
tcagtgttcatgtagatgtttaagctc

SEQ ID NO: 44984 - DNA, 16 bp, Homo sapiens
cagggctggcagggag

SEQ ID NO: 44985 - DNA, 22 bp, Homo sapiens
cagggctggcagggaggctggg

SEQ ID NO: 44986 - DNA, 24 bp, Homo sapiens
cagggaggctgggaggggctggct

SEQ ID NO: 44987 - DNA, 16 bp, Homo sapiens
tgggcatcagctggcc

SEQ ID NO: 44988 - DNA, 20 bp, Homo sapiens
ctggccctcatttcttaaga

SEQ ID NO: 44989 - DNA, 21 bp, Homo sapiens
atctgtaagagaaagtaaatg

SEQ ID NO: 44990 - DNA, 22 bp, Homo sapiens
tgatctgtaagagaaagtaaat

SEQ ID NO: 44991 - DNA, 21 bp, Homo sapiens
tgatctgtaagagaaagtaaa

SEQ ID NO: 44992 - DNA, 22 bp, Homo sapiens
acagtgatctgtaagagaaagt

SEQ ID NO: 44993 - DNA, 27 bp, Homo sapiens
tctgaggggtttggaatgggatggcag

SEQ ID NO: 44994 - DNA, 23 bp, Homo sapiens
tgaggggtttggaatgggatggc

SEQ ID NO: 44995 - DNA, 25 bp, Homo sapiens
tctgaggggtttggaatgggatggc

SEQ ID NO: 44996 - DNA, 24 bp, Homo sapiens
tctgaggggtttggaatgggatgg

SEQ ID NO: 44997 - DNA, 21 bp, Homo sapiens
tgaggggtttggaatgggatg

SEQ ID NO: 44998 - DNA, 22 bp, Homo sapiens
tctgaggggtttggaatgggat

SEQ ID NO: 44999 - DNA, 19 bp, Homo sapiens
tgaggggtttggaatggga

SEQ ID NO: 45000 - DNA, 20 bp, Homo sapiens
tctgaggggtttggaatggg

SEQ ID NO: 45001 - DNA, 24 bp, Homo sapiens
ctaccctcggtctgcttaccacac

SEQ ID NO: 45002 - DNA, 22 bp, Homo sapiens
taccctcggtctgcttaccaca

SEQ ID NO: 45003 - DNA, 22 bp, Homo sapiens
ctaccctcggtctgcttaccac

SEQ ID NO: 45004 - DNA, 21 bp, Homo sapiens
ctaccctcggtctgcttacca

SEQ ID NO: 45005 - DNA, 20 bp, Homo sapiens
ctaccctcggtctgcttacc

SEQ ID NO: 45006 - DNA, 22 bp, Homo sapiens
tgctaccctcggtctgcttacc

SEQ ID NO: 45007 - DNA, 24 bp, Homo sapiens
tgggaggtggatgtttacttcagc

SEQ ID NO: 45008 - DNA, 25 bp, Homo sapiens
ctgggaggtggatgtttacttcagc

SEQ ID NO: 45009 - DNA, 24 bp, Homo sapiens
ctgggaggtggatgtttacttcag

SEQ ID NO: 45010 - DNA, 23 bp, Homo sapiens
ctgggaggtggatgtttacttca

SEQ ID NO: 45011 - DNA, 21 bp, Homo sapiens
ctgggaggtggatgtttactt

SEQ ID NO: 45012 - DNA, 20 bp, Homo sapiens
ctgggaggtggatgtttact

SEQ ID NO: 45013 - DNA, 18 bp, Homo sapiens
ctgggaggtggatgttta

SEQ ID NO: 45014 - DNA, 24 bp, Homo sapiens
tgtaaacatcctacactcagctgt

SEQ ID NO: 45015 - DNA, 23 bp, Homo sapiens
tgtaaacatcctacactcagctg

SEQ ID NO: 45016 - DNA, 21 bp, Homo sapiens
gtaaacatcctacactcagct

SEQ ID NO: 45017 - DNA, 21 bp, Homo sapiens
tgtaaacatcctacactcagc

SEQ ID NO: 45018 - DNA, 20 bp, Homo sapiens
tgtaaacatcctacactcag

SEQ ID NO: 45019 - DNA, 19 bp, Homo sapiens
tgtaaacatcctacactca

SEQ ID NO: 45020 - DNA, 27 bp, Homo sapiens
ctttcagtcagatgtttgctgctaccg

SEQ ID NO: 45021 - DNA, 25 bp, Homo sapiens
tttcagtcagatgtttgctgctacc

SEQ ID NO: 45022 - DNA, 26 bp, Homo sapiens
ctttcagtcagatgtttgctgctacc

SEQ ID NO: 45023 - DNA, 23 bp, Homo sapiens
tttcagtcagatgtttgctgcta

SEQ ID NO: 45024 - DNA, 24 bp, Homo sapiens
ctttcagtcagatgtttgctgcta

SEQ ID NO: 45025 - DNA, 22 bp, Homo sapiens
tttcagtcagatgtttgctgct

SEQ ID NO: 45026 - DNA, 23 bp, Homo sapiens
ctttcagtcagatgtttgctgct

SEQ ID NO: 45027 - DNA, 21 bp, Homo sapiens
tttcagtcagatgtttgctgc

SEQ ID NO: 45028 - DNA, 27 bp, Homo sapiens
ctaagctttcagtcagatgtttgctgc

SEQ ID NO: 45029 - DNA, 20 bp, Homo sapiens
tttcagtcagatgtttgctg

SEQ ID NO: 45030 - DNA, 21 bp, Homo sapiens
ctttcagtcagatgtttgctg

SEQ ID NO: 45031 - DNA, 20 bp, Homo sapiens
ctttcagtcagatgtttgct

SEQ ID NO: 45032 - DNA, 25 bp, Homo sapiens
gctaagctttcagtcagatgtttgc

SEQ ID NO: 45033 - DNA, 21 bp, Homo sapiens
taagctttcagtcagatgttt

SEQ ID NO: 45034 - DNA, 25 bp, Homo sapiens
tgtaaacatccccgactggaagctg

SEQ ID NO: 45035 - DNA, 24 bp, Homo sapiens
tgtaaacatccccgactggaagct

SEQ ID NO: 45036 - DNA, 23 bp, Homo sapiens
tgtaaacatccccgactggaagc

SEQ ID NO: 45037 - DNA, 21 bp, Homo sapiens
tgtaaacatccccgactggaa

SEQ ID NO: 45038 - DNA, 20 bp, Homo sapiens
tgtaaacatccccgactgga

SEQ ID NO: 45039 - DNA, 19 bp, Homo sapiens
tgtaaacatccccgactgg

SEQ ID NO: 45040 - DNA, 24 bp, Homo sapiens
ctagactgaagctccttgaggaca

SEQ ID NO: 45041 - DNA, 19 bp, Homo sapiens
actgaagctccttgaggac

SEQ ID NO: 45042 - DNA, 21 bp, Homo sapiens
agactgaagctccttgaggac

SEQ ID NO: 45043 - DNA, 23 bp, Homo sapiens
ctagactgaagctccttgaggac

SEQ ID NO: 45044 - DNA, 24 bp, Homo sapiens
actagactgaagctccttgaggac

SEQ ID NO: 45045 - DNA, 25 bp, Homo sapiens
tactagactgaagctccttgaggac

SEQ ID NO: 45046 - DNA, 18 bp, Homo sapiens
actgaagctccttgagga

SEQ ID NO: 45047 - DNA, 22 bp, Homo sapiens
ctagactgaagctccttgagga

SEQ ID NO: 45048 - DNA, 24 bp, Homo sapiens
tactagactgaagctccttgagga

SEQ ID NO: 45049 - DNA, 23 bp, Homo sapiens
tactagactgaagctccttgagg

SEQ ID NO: 45050 - DNA, 22 bp, Homo sapiens
tactagactgaagctccttgag

SEQ ID NO: 45051 - DNA, 20 bp, Homo sapiens
tactagactgaagctccttg

SEQ ID NO: 45052 - DNA, 19 bp, Homo sapiens
tactagactgaagctcctt

SEQ ID NO: 45053 - DNA, 27 bp, Homo sapiens
tcgaggagctcacagtctagtatgtct

SEQ ID NO: 45054 - DNA, 26 bp, Homo sapiens
tcgaggagctcacagtctagtatgtc

SEQ ID NO: 45055 - DNA, 25 bp, Homo sapiens
tcgaggagctcacagtctagtatgt

SEQ ID NO: 45056 - DNA, 22 bp, Homo sapiens
gaggagctcacagtctagtatg

SEQ ID NO: 45057 - DNA, 23 bp, Homo sapiens
cgaggagctcacagtctagtatg

SEQ ID NO: 45058 - DNA, 24 bp, Homo sapiens
tcgaggagctcacagtctagtatg

SEQ ID NO: 45059 - DNA, 25 bp, Homo sapiens
ctcgaggagctcacagtctagtatg

SEQ ID NO: 45060 - DNA, 22 bp, Homo sapiens
cgaggagctcacagtctagtat

SEQ ID NO: 45061 - DNA, 23 bp, Homo sapiens
tcgaggagctcacagtctagtat

SEQ ID NO: 45062 - DNA, 24 bp, Homo sapiens
ctcgaggagctcacagtctagtat

SEQ ID NO: 45063 - DNA, 26 bp, Homo sapiens
cttccggtctgtgagccccgtcctcc

SEQ ID NO: 45064 - DNA, 24 bp, Homo sapiens
ttccggtctgtgagccccgtcctc

SEQ ID NO: 45065 - DNA, 25 bp, Homo sapiens
cttccggtctgtgagccccgtcctc

SEQ ID NO: 45066 - DNA, 22 bp, Homo sapiens
tccggtctgtgagccccgtcct

SEQ ID NO: 45067 - DNA, 21 bp, Homo sapiens
tccggtctgtgagccccgtcc

SEQ ID NO: 45068 - DNA, 22 bp, Homo sapiens
ttccggtctgtgagccccgtcc

SEQ ID NO: 45069 - DNA, 23 bp, Homo sapiens
cttccggtctgtgagccccgtcc

SEQ ID NO: 45070 - DNA, 24 bp, Homo sapiens
gacttccggtctgtgagccccgtc

SEQ ID NO: 45071 - DNA, 21 bp, Homo sapiens
cttccggtctgtgagccccgt

SEQ ID NO: 45072 - DNA, 16 bp, Homo sapiens
cttccggtctgtgagc

SEQ ID NO: 45073 - DNA, 22 bp, Homo sapiens
gagcgacttccggtctgtgagc

SEQ ID NO: 45074 - DNA, 26 bp, Homo sapiens
tggggtgcccactccgcaagttatca

SEQ ID NO: 45075 - DNA, 25 bp, Homo sapiens
tggggtgcccactccgcaagttatc

SEQ ID NO: 45076 - DNA, 24 bp, Homo sapiens
tggggtgcccactccgcaagttat

SEQ ID NO: 45077 - DNA, 23 bp, Homo sapiens
tggggtgcccactccgcaagtta

SEQ ID NO: 45078 - DNA, 21 bp, Homo sapiens
ggggtgcccactccgcaagtt

SEQ ID NO: 45079 - DNA, 21 bp, Homo sapiens
tggggtgcccactccgcaagt

SEQ ID NO: 45080 - DNA, 20 bp, Homo sapiens
tggggtgcccactccgcaag

SEQ ID NO: 45081 - DNA, 19 bp, Homo sapiens
tggggtgcccactccgcaa

SEQ ID NO: 45082 - DNA, 18 bp, Homo sapiens
tggggtgcccactccgca

SEQ ID NO: 45083 - DNA, 17 bp, Homo sapiens
tggggtgcccactccgc

SEQ ID NO: 45084 - DNA, 25 bp, Homo sapiens
tccgcgctctgactctctgcccacc

SEQ ID NO: 45085 - DNA, 24 bp, Homo sapiens
tccgcgctctgactctctgcccac

SEQ ID NO: 45086 - DNA, 25 bp, Homo sapiens
atccgcgctctgactctctgcccac

SEQ ID NO: 45087 - DNA, 23 bp, Homo sapiens
tccgcgctctgactctctgccca

SEQ ID NO: 45088 - DNA, 24 bp, Homo sapiens
atccgcgctctgactctctgccca

SEQ ID NO: 45089 - DNA, 23 bp, Homo sapiens
atccgcgctctgactctctgccc

SEQ ID NO: 45090 - DNA, 18 bp, Homo sapiens
cgcgctctgactctctgc

SEQ ID NO: 45091 - DNA, 21 bp, Homo sapiens
atccgcgctctgactctctgc

SEQ ID NO: 45092 - DNA, 22 bp, Homo sapiens
catccgcgctctgactctctgc

SEQ ID NO: 45093 - DNA, 24 bp, Homo sapiens
cccatccgcgctctgactctctgc

SEQ ID NO: 45094 - DNA, 20 bp, Homo sapiens
atccgcgctctgactctctg

SEQ ID NO: 45095 - DNA, 19 bp, Homo sapiens
atccgcgctctgactctct

SEQ ID NO: 45096 - DNA, 22 bp, Homo sapiens
cccatccgcgctctgactctct

SEQ ID NO: 45097 - DNA, 18 bp, Homo sapiens
atccgcgctctgactctc

SEQ ID NO: 45098 - DNA, 21 bp, Homo sapiens
cccatccgcgctctgactctc

SEQ ID NO: 45099 - DNA, 20 bp, Homo sapiens
cccatccgcgctctgactct

SEQ ID NO: 45100 - DNA, 16 bp, Homo sapiens
atccgcgctctgactc

SEQ ID NO: 45101 - DNA, 26 bp, Homo sapiens
gtgagtcagggtggggctggccccct

SEQ ID NO: 45102 - DNA, 25 bp, Homo sapiens
gtgagtcagggtggggctggccccc

SEQ ID NO: 45103 - DNA, 24 bp, Homo sapiens
gtgagtcagggtggggctggcccc

SEQ ID NO: 45104 - DNA, 23 bp, Homo sapiens
gtgagtcagggtggggctggccc

SEQ ID NO: 45105 - DNA, 22 bp, Homo sapiens
gtgagtcagggtggggctggcc

SEQ ID NO: 45106 - DNA, 21 bp, Homo sapiens
gtgagtcagggtggggctggc

SEQ ID NO: 45107 - DNA, 25 bp, Homo sapiens
cctctcctccctgtgccccaggagt

SEQ ID NO: 45108 - DNA, 23 bp, Homo sapiens
cctctcctccctgtgccccagga

SEQ ID NO: 45109 - DNA, 22 bp, Homo sapiens
cctctcctccctgtgccccagg

SEQ ID NO: 45110 - DNA, 20 bp, Homo sapiens
cctctcctccctgtgcccca

SEQ ID NO: 45111 - DNA, 25 bp, Homo sapiens
cggggccagagcagagagcccttgc

SEQ ID NO: 45112 - DNA, 24 bp, Homo sapiens
cggggccagagcagagagcccttg

SEQ ID NO: 45113 - DNA, 23 bp, Homo sapiens
cggggccagagcagagagccctt

SEQ ID NO: 45114 - DNA, 25 bp, Homo sapiens
tgcggggccagagcagagagccctt

SEQ ID NO: 45115 - DNA, 23 bp, Homo sapiens
gcggggccagagcagagagccct

SEQ ID NO: 45116 - DNA, 23 bp, Homo sapiens
tgcggggccagagcagagagccc

SEQ ID NO: 45117 - DNA, 20 bp, Homo sapiens
cggggccagagcagagagcc

SEQ ID NO: 45118 - DNA, 22 bp, Homo sapiens
tgcggggccagagcagagagcc

SEQ ID NO: 45119 - DNA, 20 bp, Homo sapiens
gcggggccagagcagagagc

SEQ ID NO: 45120 - DNA, 18 bp, Homo sapiens
cggggccagagcagagag

SEQ ID NO: 45121 - DNA, 20 bp, Homo sapiens
tgcggggccagagcagagag

SEQ ID NO: 45122 - DNA, 22 bp, Homo sapiens
actgcggggccagagcagagag

SEQ ID NO: 45123 - DNA, 18 bp, Homo sapiens
gcggggccagagcagaga

SEQ ID NO: 45124 - DNA, 22 bp, Homo sapiens
tgcctgggtctctggcctgcgc

SEQ ID NO: 45125 - DNA, 25 bp, Homo sapiens
ggctgcctgggtctctggcctgcgc

SEQ ID NO: 45126 - DNA, 16 bp, Homo sapiens
tcgggctgcctgggtc

SEQ ID NO: 45127 - DNA, 24 bp, Homo sapiens
ccccttctgtctccctaggcaaga

SEQ ID NO: 45128 - DNA, 23 bp, Homo sapiens
tgaccccttctgtctccctaggc

SEQ ID NO: 45129 - DNA, 22 bp, Homo sapiens
tgaccccttctgtctccctagg

SEQ ID NO: 45130 - DNA, 23 bp, Homo sapiens
ctgaccccttctgtctccctagg

SEQ ID NO: 45131 - DNA, 20 bp, Homo sapiens
gaccccttctgtctccctag

SEQ ID NO: 45132 - DNA, 22 bp, Homo sapiens
ctgaccccttctgtctccctag

SEQ ID NO: 45133 - DNA, 23 bp, Homo sapiens
cactgaccccttctgtctcccta

SEQ ID NO: 45134 - DNA, 24 bp, Homo sapiens
tgggggctggatggggtagagtag

SEQ ID NO: 45135 - DNA, 26 bp, Homo sapiens
gctgggggctggatggggtagagtag

SEQ ID NO: 45136 - DNA, 23 bp, Homo sapiens
tgggggctggatggggtagagta

SEQ ID NO: 45137 - DNA, 23 bp, Homo sapiens
ctgggggctggatggggtagagt

SEQ ID NO: 45138 - DNA, 24 bp, Homo sapiens
gctgggggctggatggggtagagt

SEQ ID NO: 45139 - DNA, 21 bp, Homo sapiens
tgggggctggatggggtagag

SEQ ID NO: 45140 - DNA, 22 bp, Homo sapiens
ctgggggctggatggggtagag

SEQ ID NO: 45141 - DNA, 22 bp, Homo sapiens
agacccacagaggacagtggag

SEQ ID NO: 45142 - DNA, 21 bp, Homo sapiens
cacagaggacagtggagtgtg

SEQ ID NO: 45143 - DNA, 22 bp, Homo sapiens
cacagaggacagtggagtgtga

SEQ ID NO: 45144 - DNA, 23 bp, Homo sapiens
cacagaggacagtggagtgtgag

SEQ ID NO: 45145 - DNA, 24 bp, Homo sapiens
cacagaggacagtggagtgtgagc

SEQ ID NO: 45146 - DNA, 25 bp, Homo sapiens
cacagaggacagtggagtgtgagct

SEQ ID NO: 45147 - DNA, 19 bp, Homo sapiens
acagaggacagtggagtgt

SEQ ID NO: 45148 - DNA, 20 bp, Homo sapiens
acagaggacagtggagtgtg

SEQ ID NO: 45149 - DNA, 21 bp, Homo sapiens
acagaggacagtggagtgtga

SEQ ID NO: 45150 - DNA, 22 bp, Homo sapiens
acagaggacagtggagtgtgag

SEQ ID NO: 45151 - DNA, 24 bp, Homo sapiens
acagaggacagtggagtgtgagct

SEQ ID NO: 45152 - DNA, 25 bp, Homo sapiens
acagaggacagtggagtgtgagctg

SEQ ID NO: 45153 - DNA, 26 bp, Homo sapiens
acagaggacagtggagtgtgagctgg

SEQ ID NO: 45154 - DNA, 21 bp, Homo sapiens
cagaggacagtggagtgtgag

SEQ ID NO: 45155 - DNA, 22 bp, Homo sapiens
cagaggacagtggagtgtgagc

SEQ ID NO: 45156 - DNA, 23 bp, Homo sapiens
cagaggacagtggagtgtgagct

SEQ ID NO: 45157 - DNA, 18 bp, Homo sapiens
ggctcatgtgtctgtcct

SEQ ID NO: 45158 - DNA, 20 bp, Homo sapiens
ggctcatgtgtctgtcctct

SEQ ID NO: 45159 - DNA, 21 bp, Homo sapiens
ggctcatgtgtctgtcctctt

SEQ ID NO: 45160 - DNA, 23 bp, Homo sapiens
ggctcatgtgtctgtcctcttcc

SEQ ID NO: 45161 - DNA, 21 bp, Homo sapiens
ctcatgtgtctgtcctcttcc

SEQ ID NO: 45162 - DNA, 22 bp, Homo sapiens
ctcatgtgtctgtcctcttcca

SEQ ID NO: 45163 - DNA, 23 bp, Homo sapiens
tcatgtgtctgtcctcttccaga

SEQ ID NO: 45164 - DNA, 21 bp, Homo sapiens
tggtctcttggcccccaggaa

SEQ ID NO: 45165 - DNA, 22 bp, Homo sapiens
gtggtctcttggcccccaggaa

SEQ ID NO: 45166 - DNA, 21 bp, Homo sapiens
gtggtctcttggcccccagga

SEQ ID NO: 45167 - DNA, 20 bp, Homo sapiens
gtggtctcttggcccccagg

SEQ ID NO: 45168 - DNA, 21 bp, Homo sapiens
tgtggtctcttggcccccagg

SEQ ID NO: 45169 - DNA, 22 bp, Homo sapiens
ctgtggtctcttggcccccagg

SEQ ID NO: 45170 - DNA, 22 bp, Homo sapiens
cctgtggtctcttggcccccag

SEQ ID NO: 45171 - DNA, 20 bp, Homo sapiens
ccccctgtggtctcttggcc

SEQ ID NO: 45172 - DNA, 24 bp, Homo sapiens
gctgggatgggccatggtgtgctc

SEQ ID NO: 45173 - DNA, 25 bp, Homo sapiens
tgggggctgggatgggccatggtgt

SEQ ID NO: 45174 - DNA, 27 bp, Homo sapiens
cctgggggctgggatgggccatggtgt

SEQ ID NO: 45175 - DNA, 28 bp, Homo sapiens
ccctgggggctgggatgggccatggtgt

SEQ ID NO: 45176 - DNA, 23 bp, Homo sapiens
gggggctgggatgggccatggtg

SEQ ID NO: 45177 - DNA, 24 bp, Homo sapiens
tgggggctgggatgggccatggtg

SEQ ID NO: 45178 - DNA, 25 bp, Homo sapiens
ctgggggctgggatgggccatggtg

SEQ ID NO: 45179 - DNA, 24 bp, Homo sapiens
ctgggggctgggatgggccatggt

SEQ ID NO: 45180 - DNA, 25 bp, Homo sapiens
cctgggggctgggatgggccatggt

SEQ ID NO: 45181 - DNA, 22 bp, Homo sapiens
tgggggctgggatgggccatgg

SEQ ID NO: 45182 - DNA, 21 bp, Homo sapiens
tgggggctgggatgggccatg

SEQ ID NO: 45183 - DNA, 26 bp, Homo sapiens
cctgggcctctgctccccagtgtctg

SEQ ID NO: 45184 - DNA, 22 bp, Homo sapiens
tgggcctctgctccccagtgtc

SEQ ID NO: 45185 - DNA, 23 bp, Homo sapiens
ctgggcctctgctccccagtgtc

SEQ ID NO: 45186 - DNA, 25 bp, Homo sapiens
ccctgggcctctgctccccagtgtc

SEQ ID NO: 45187 - DNA, 22 bp, Homo sapiens
ctgggcctctgctccccagtgt

SEQ ID NO: 45188 - DNA, 21 bp, Homo sapiens
ctgggcctctgctccccagtg

SEQ ID NO: 45189 - DNA, 22 bp, Homo sapiens
cctgggcctctgctccccagtg

SEQ ID NO: 45190 - DNA, 23 bp, Homo sapiens
ccctgggcctctgctccccagtg

SEQ ID NO: 45191 - DNA, 20 bp, Homo sapiens
ctgggcctctgctccccagt

SEQ ID NO: 45192 - DNA, 22 bp, Homo sapiens
ccctgggcctctgctccccagt

SEQ ID NO: 45193 - DNA, 19 bp, Homo sapiens
ctgggcctctgctccccag

SEQ ID NO: 45194 - DNA, 18 bp, Homo sapiens
ctgggcctctgctcccca

SEQ ID NO: 45195 - DNA, 19 bp, Homo sapiens
cctgggcctctgctcccca

SEQ ID NO: 45196 - DNA, 20 bp, Homo sapiens
ccctgggcctctgctcccca

SEQ ID NO: 45197 - DNA, 18 bp, Homo sapiens
cctgggcctctgctcccc

SEQ ID NO: 45198 - DNA, 19 bp, Homo sapiens
ccctgggcctctgctcccc

SEQ ID NO: 45199 - DNA, 18 bp, Homo sapiens
ccctgggcctctgctccc

SEQ ID NO: 45200 - DNA, 27 bp, Homo sapiens
tggggagctgaggctctgggggtggcc

SEQ ID NO: 45201 - DNA, 28 bp, Homo sapiens
ctggggagctgaggctctgggggtggcc

SEQ ID NO: 45202 - DNA, 25 bp, Homo sapiens
tggggagctgaggctctgggggtgg

SEQ ID NO: 45203 - DNA, 26 bp, Homo sapiens
ctggggagctgaggctctgggggtgg

SEQ ID NO: 45204 - DNA, 27 bp, Homo sapiens
cctggggagctgaggctctgggggtgg

SEQ ID NO: 45205 - DNA, 23 bp, Homo sapiens
tggggagctgaggctctgggggt

SEQ ID NO: 45206 - DNA, 24 bp, Homo sapiens
ctggggagctgaggctctgggggt

SEQ ID NO: 45207 - DNA, 25 bp, Homo sapiens
cctggggagctgaggctctgggggt

SEQ ID NO: 45208 - DNA, 27 bp, Homo sapiens
gccctggggagctgaggctctgggggt

SEQ ID NO: 45209 - DNA, 20 bp, Homo sapiens
gggagctgaggctctggggg

SEQ ID NO: 45210 - DNA, 21 bp, Homo sapiens
ggggagctgaggctctggggg

SEQ ID NO: 45211 - DNA, 22 bp, Homo sapiens
tggggagctgaggctctggggg

SEQ ID NO: 45212 - DNA, 24 bp, Homo sapiens
cctggggagctgaggctctggggg

SEQ ID NO: 45213 - DNA, 25 bp, Homo sapiens
ccctggggagctgaggctctggggg

SEQ ID NO: 45214 - DNA, 23 bp, Homo sapiens
cctggggagctgaggctctgggg

SEQ ID NO: 45215 - DNA, 24 bp, Homo sapiens
ccctggggagctgaggctctgggg

SEQ ID NO: 45216 - DNA, 22 bp, Homo sapiens
cctggggagctgaggctctggg

SEQ ID NO: 45217 - DNA, 23 bp, Homo sapiens
ccctggggagctgaggctctggg

SEQ ID NO: 45218 - DNA, 21 bp, Homo sapiens
cctggggagctgaggctctgg

SEQ ID NO: 45219 - DNA, 22 bp, Homo sapiens
ccctggggagctgaggctctgg

SEQ ID NO: 45220 - DNA, 20 bp, Homo sapiens
ccctggggagctgaggctct

SEQ ID NO: 45221 - DNA, 25 bp, Homo sapiens
tcggcctgaccacccaccccacagg

SEQ ID NO: 45222 - DNA, 24 bp, Homo sapiens
tcggcctgaccacccaccccacag

SEQ ID NO: 45223 - DNA, 22 bp, Homo sapiens
cggcctgaccacccaccccaca

SEQ ID NO: 45224 - DNA, 23 bp, Homo sapiens
tcggcctgaccacccaccccaca

SEQ ID NO: 45225 - DNA, 21 bp, Homo sapiens
cggcctgaccacccaccccac

SEQ ID NO: 45226 - DNA, 21 bp, Homo sapiens
tcggcctgaccacccacccca

SEQ ID NO: 45227 - DNA, 20 bp, Homo sapiens
tcggcctgaccacccacccc

SEQ ID NO: 45228 - DNA, 24 bp, Homo sapiens
ccagcctgtgtccacctccaggtg

SEQ ID NO: 45229 - DNA, 25 bp, Homo sapiens
accagcctgtgtccacctccaggtg

SEQ ID NO: 45230 - DNA, 23 bp, Homo sapiens
ccagcctgtgtccacctccaggt

SEQ ID NO: 45231 - DNA, 24 bp, Homo sapiens
accagcctgtgtccacctccaggt

SEQ ID NO: 45232 - DNA, 22 bp, Homo sapiens
ccagcctgtgtccacctccagg

SEQ ID NO: 45233 - DNA, 23 bp, Homo sapiens
accagcctgtgtccacctccagg

SEQ ID NO: 45234 - DNA, 25 bp, Homo sapiens
cccaccagcctgtgtccacctccag

SEQ ID NO: 45235 - DNA, 21 bp, Homo sapiens
accagcctgtgtccacctcca

SEQ ID NO: 45236 - DNA, 20 bp, Homo sapiens
accagcctgtgtccacctcc

SEQ ID NO: 45237 - DNA, 23 bp, Homo sapiens
cccaccagcctgtgtccacctcc

SEQ ID NO: 45238 - DNA, 19 bp, Homo sapiens
accagcctgtgtccacctc

SEQ ID NO: 45239 - DNA, 22 bp, Homo sapiens
cccaccagcctgtgtccacctc

SEQ ID NO: 45240 - DNA, 20 bp, Homo sapiens
cccaccagcctgtgtccacc

SEQ ID NO: 45241 - DNA, 19 bp, Homo sapiens
cccaccagcctgtgtccac

SEQ ID NO: 45242 - DNA, 17 bp, Homo sapiens
gagtgtgtggagagagc

SEQ ID NO: 45243 - DNA, 24 bp, Homo sapiens
agtggataggggagtgtgtggaga

SEQ ID NO: 45244 - DNA, 23 bp, Homo sapiens
agtggataggggagtgtgtggag

SEQ ID NO: 45245 - DNA, 22 bp, Homo sapiens
agtggataggggagtgtgtgga

SEQ ID NO: 45246 - DNA, 21 bp, Homo sapiens
agtggataggggagtgtgtgg

SEQ ID NO: 45247 - DNA, 22 bp, Homo sapiens
gggagtggataggggagtgtgt

SEQ ID NO: 45248 - DNA, 25 bp, Homo sapiens
ccctgctgccttcacctgccagggt

SEQ ID NO: 45249 - DNA, 24 bp, Homo sapiens
ccctgctgccttcacctgccaggg

SEQ ID NO: 45250 - DNA, 23 bp, Homo sapiens
ccctgctgccttcacctgccagg

SEQ ID NO: 45251 - DNA, 24 bp, Homo sapiens
gccctgctgccttcacctgccagg

SEQ ID NO: 45252 - DNA, 26 bp, Homo sapiens
cagccctgctgccttcacctgccagg

SEQ ID NO: 45253 - DNA, 21 bp, Homo sapiens
ccctgctgccttcacctgcca

SEQ ID NO: 45254 - DNA, 20 bp, Homo sapiens
ccctgctgccttcacctgcc

SEQ ID NO: 45255 - DNA, 26 bp, Homo sapiens
caggcaggtgtagggtggagcccact

SEQ ID NO: 45256 - DNA, 22 bp, Homo sapiens
aggcaggtgtagggtggagccc

SEQ ID NO: 45257 - DNA, 23 bp, Homo sapiens
caggcaggtgtagggtggagccc

SEQ ID NO: 45258 - DNA, 21 bp, Homo sapiens
aggcaggtgtagggtggagcc

SEQ ID NO: 45259 - DNA, 22 bp, Homo sapiens
caggcaggtgtagggtggagcc

SEQ ID NO: 45260 - DNA, 20 bp, Homo sapiens
aggcaggtgtagggtggagc

SEQ ID NO: 45261 - DNA, 20 bp, Homo sapiens
caggcaggtgtagggtggag

SEQ ID NO: 45262 - DNA, 18 bp, Homo sapiens
aggcaggtgtagggtgga

SEQ ID NO: 45263 - DNA, 18 bp, Homo sapiens
caggcaggtgtagggtgg

SEQ ID NO: 45264 - DNA, 21 bp, Homo sapiens
ccggaacgccgcactcacgcc

SEQ ID NO: 45265 - DNA, 23 bp, Homo sapiens
ccggccggaacgccgcactcacg

SEQ ID NO: 45266 - DNA, 17 bp, Homo sapiens
ccggaacgccgcactca

SEQ ID NO: 45267 - DNA, 18 bp, Homo sapiens
gccggaacgccgcactca

SEQ ID NO: 45268 - DNA, 21 bp, Homo sapiens
ccggccggaacgccgcactca

SEQ ID NO: 45269 - DNA, 22 bp, Homo sapiens
cccggccggaacgccgcactca

SEQ ID NO: 45270 - DNA, 16 bp, Homo sapiens
ccggaacgccgcactc

SEQ ID NO: 45271 - DNA, 21 bp, Homo sapiens
cccggccggaacgccgcactc

SEQ ID NO: 45272 - DNA, 23 bp, Homo sapiens
gggacgcccggccggaacgccgc

SEQ ID NO: 45273 - DNA, 18 bp, Homo sapiens
gggacgcccggccggaac

SEQ ID NO: 45274 - DNA, 17 bp, Homo sapiens
tggccggggcgggaggg

SEQ ID NO: 45275 - DNA, 20 bp, Homo sapiens
cgctggccggggcgggaggg

SEQ ID NO: 45276 - DNA, 23 bp, Homo sapiens
gtgcggaacgctggccggggcgg

SEQ ID NO: 45277 - DNA, 18 bp, Homo sapiens
cggaacgctggccggggc

SEQ ID NO: 45278 - DNA, 21 bp, Homo sapiens
gtgcggaacgctggccggggc

SEQ ID NO: 45279 - DNA, 20 bp, Homo sapiens
gtgcggaacgctggccgggg

SEQ ID NO: 45280 - DNA, 19 bp, Homo sapiens
gtgcggaacgctggccggg

SEQ ID NO: 45281 - DNA, 18 bp, Homo sapiens
gtgcggaacgctggccgg

SEQ ID NO: 45282 - DNA, 17 bp, Homo sapiens
gtgcggaacgctggccg

SEQ ID NO: 45283 - DNA, 20 bp, Homo sapiens
gtcaaggtgcggaacgctgg

SEQ ID NO: 45284 - DNA, 17 bp, Homo sapiens
gtcaaggtgcggaacgc

SEQ ID NO: 45285 - DNA, 23 bp, Homo sapiens
cacagcactgcctggtcagaaag

SEQ ID NO: 45286 - DNA, 23 bp, Homo sapiens
ccacagcactgcctggtcagaaa

SEQ ID NO: 45287 - DNA, 22 bp, Homo sapiens
ccacagcactgcctggtcagaa

SEQ ID NO: 45288 - DNA, 21 bp, Homo sapiens
ccacagcactgcctggtcaga

SEQ ID NO: 45289 - DNA, 20 bp, Homo sapiens
ccacagcactgcctggtcag

SEQ ID NO: 45290 - DNA, 19 bp, Homo sapiens
ggtgattgtggctttgggt

SEQ ID NO: 45291 - DNA, 24 bp, Homo sapiens
gatcagaaggtgattgtggctttg

SEQ ID NO: 45292 - DNA, 25 bp, Homo sapiens
agatcagaaggtgattgtggctttg

SEQ ID NO: 45293 - DNA, 24 bp, Homo sapiens
agatcagaaggtgattgtggcttt

SEQ ID NO: 45294 - DNA, 23 bp, Homo sapiens
agatcagaaggtgattgtggctt

SEQ ID NO: 45295 - DNA, 24 bp, Homo sapiens
cagatcagaaggtgattgtggctt

SEQ ID NO: 45296 - DNA, 23 bp, Homo sapiens
cagatcagaaggtgattgtggct

SEQ ID NO: 45297 - DNA, 22 bp, Homo sapiens
cagatcagaaggtgattgtggc

SEQ ID NO: 45298 - DNA, 20 bp, Homo sapiens
agatcagaaggtgattgtgg

SEQ ID NO: 45299 - DNA, 21 bp, Homo sapiens
cagatcagaaggtgattgtgg

SEQ ID NO: 45300 - DNA, 19 bp, Homo sapiens
agatcagaaggtgattgtg

SEQ ID NO: 45301 - DNA, 27 bp, Homo sapiens
agctacagttacttttgcaccagccta

SEQ ID NO: 45302 - DNA, 24 bp, Homo sapiens
agctacagttacttttgcaccagc

SEQ ID NO: 45303 - DNA, 25 bp, Homo sapiens
aagctacagttacttttgcaccagc

SEQ ID NO: 45304 - DNA, 26 bp, Homo sapiens
aaagctacagttacttttgcaccagc

SEQ ID NO: 45305 - DNA, 23 bp, Homo sapiens
agctacagttacttttgcaccag

SEQ ID NO: 45306 - DNA, 21 bp, Homo sapiens
agctacagttacttttgcacc

SEQ ID NO: 45307 - DNA, 22 bp, Homo sapiens
aagctacagttacttttgcacc

SEQ ID NO: 45308 - DNA, 23 bp, Homo sapiens
aaagctacagttacttttgcacc

SEQ ID NO: 45309 - DNA, 20 bp, Homo sapiens
agctacagttacttttgcac

SEQ ID NO: 45310 - DNA, 22 bp, Homo sapiens
aaagctacagttacttttgcac

SEQ ID NO: 45311 - DNA, 16 bp, Homo sapiens
tctccgaagcctgccc

SEQ ID NO: 45312 - DNA, 22 bp, Homo sapiens
tccgaagcctgcccggctcctc

SEQ ID NO: 45313 - DNA, 20 bp, Homo sapiens
aagcctgcccggctcctcgg

SEQ ID NO: 45314 - DNA, 26 bp, Homo sapiens
aagcctgcccggctcctcgggaacct

SEQ ID NO: 45315 - DNA, 19 bp, Homo sapiens
ccggctcctcgggaacctg

SEQ ID NO: 45316 - DNA, 17 bp, Homo sapiens
ctgaggtccgggctgtg

SEQ ID NO: 45317 - DNA, 25 bp, Homo sapiens
acagggccctggctttagcagaatt

SEQ ID NO: 45318 - DNA, 20 bp, Homo sapiens
cagggccctggctttagcag

SEQ ID NO: 45319 - DNA, 24 bp, Homo sapiens
cagggccctggctttagcagaatt

SEQ ID NO: 45320 - DNA, 25 bp, Homo sapiens
aaaagctgggttgagagggcgaaaa

SEQ ID NO: 45321 - DNA, 22 bp, Homo sapiens
aagctgggttgagagggcgaaa

SEQ ID NO: 45322 - DNA, 23 bp, Homo sapiens
aaagctgggttgagagggcgaaa

SEQ ID NO: 45323 - DNA, 24 bp, Homo sapiens
aaaagctgggttgagagggcgaaa

SEQ ID NO: 45324 - DNA, 23 bp, Homo sapiens
aaaagctgggttgagagggcgaa

SEQ ID NO: 45325 - DNA, 21 bp, Homo sapiens
aaaagctgggttgagagggcg

SEQ ID NO: 45326 - DNA, 22 bp, Homo sapiens
accttgcatctgcatccccagg

SEQ ID NO: 45327 - DNA, 24 bp, Homo sapiens
ctcaccttgcatctgcatccccag

SEQ ID NO: 45328 - DNA, 20 bp, Homo sapiens
accttgcatctgcatcccca

SEQ ID NO: 45329 - DNA, 24 bp, Homo sapiens
ggtactcagagcaagttgtgaaac

SEQ ID NO: 45330 - DNA, 24 bp, Homo sapiens
tagggtactcagagcaagttgtga

SEQ ID NO: 45331 - DNA, 21 bp, Homo sapiens
agggtactcagagcaagttgt

SEQ ID NO: 45332 - DNA, 23 bp, Homo sapiens
tgcaggaaggagacaggcagttc

SEQ ID NO: 45333 - DNA, 24 bp, Homo sapiens
tgcaggaaggagacaggcagttca

SEQ ID NO: 45334 - DNA, 25 bp, Homo sapiens
gcaggaaggagacaggcagttcagg

SEQ ID NO: 45335 - DNA, 20 bp, Homo sapiens
caggaaggagacaggcagtt

SEQ ID NO: 45336 - DNA, 21 bp, Homo sapiens
caggaaggagacaggcagttc

SEQ ID NO: 45337 - DNA, 23 bp, Homo sapiens
caggaaggagacaggcagttcag

SEQ ID NO: 45338 - DNA, 24 bp, Homo sapiens
caggaaggagacaggcagttcagg

SEQ ID NO: 45339 - DNA, 19 bp, Homo sapiens
aggaaggagacaggcagtt

SEQ ID NO: 45340 - DNA, 21 bp, Homo sapiens
aggaaggagacaggcagttca

SEQ ID NO: 45341 - DNA, 22 bp, Homo sapiens
aggaaggagacaggcagttcag

SEQ ID NO: 45342 - DNA, 20 bp, Homo sapiens
ggaaggagacaggcagttca

SEQ ID NO: 45343 - DNA, 25 bp, Homo sapiens
gagctgtctgtgttttccttctcag

SEQ ID NO: 45344 - DNA, 21 bp, Homo sapiens
agctgtctgtgttttccttct

SEQ ID NO: 45345 - DNA, 22 bp, Homo sapiens
agctgtctgtgttttccttctc

SEQ ID NO: 45346 - DNA, 23 bp, Homo sapiens
agctgtctgtgttttccttctca

SEQ ID NO: 45347 - DNA, 25 bp, Homo sapiens
agctgtctgtgttttccttctcaga

SEQ ID NO: 45348 - DNA, 24 bp, Homo sapiens
ccctgggggtggtctctagccaag

SEQ ID NO: 45349 - DNA, 25 bp, Homo sapiens
ccctgggggtggtctctagccaagg

SEQ ID NO: 45350 - DNA, 20 bp, Homo sapiens
cctgggggtggtctctagcc

SEQ ID NO: 45351 - DNA, 22 bp, Homo sapiens
cctgggggtggtctctagccaa

SEQ ID NO: 45352 - DNA, 23 bp, Homo sapiens
cctgggggtggtctctagccaag

SEQ ID NO: 45353 - DNA, 24 bp, Homo sapiens
cctgggggtggtctctagccaagg

SEQ ID NO: 45354 - DNA, 27 bp, Homo sapiens
cctgggggtggtctctagccaaggctc

SEQ ID NO: 45355 - DNA, 22 bp, Homo sapiens
ctgggggtggtctctagccaag

SEQ ID NO: 45356 - DNA, 23 bp, Homo sapiens
ctgggggtggtctctagccaagg

SEQ ID NO: 45357 - DNA, 24 bp, Homo sapiens
ctgggggtggtctctagccaaggc

SEQ ID NO: 45358 - DNA, 25 bp, Homo sapiens
ctgggggtggtctctagccaaggct

SEQ ID NO: 45359 - DNA, 26 bp, Homo sapiens
ctgggggtggtctctagccaaggctc

SEQ ID NO: 45360 - DNA, 17 bp, Homo sapiens
tgggggtggtctctagc

SEQ ID NO: 45361 - DNA, 20 bp, Homo sapiens
tgggggtggtctctagccaa

SEQ ID NO: 45362 - DNA, 21 bp, Homo sapiens
tgggggtggtctctagccaag

SEQ ID NO: 45363 - DNA, 23 bp, Homo sapiens
tgggggtggtctctagccaaggc

SEQ ID NO: 45364 - DNA, 25 bp, Homo sapiens
tgggggtggtctctagccaaggctc

SEQ ID NO: 45365 - DNA, 22 bp, Homo sapiens
gggggtggtctctagccaaggc

SEQ ID NO: 45366 - DNA, 18 bp, Homo sapiens
ttggctggtctctgctcc

SEQ ID NO: 45367 - DNA, 20 bp, Homo sapiens
ttggctggtctctgctccgc

SEQ ID NO: 45368 - DNA, 21 bp, Homo sapiens
ttggctggtctctgctccgca

SEQ ID NO: 45369 - DNA, 23 bp, Homo sapiens
ttggctggtctctgctccgcagg

SEQ ID NO: 45370 - DNA, 24 bp, Homo sapiens
ttggctggtctctgctccgcaggc

SEQ ID NO: 45371 - DNA, 25 bp, Homo sapiens
ttggctggtctctgctccgcaggcc

SEQ ID NO: 45372 - DNA, 24 bp, Homo sapiens
atggtctcctgttctctgcagagg

SEQ ID NO: 45373 - DNA, 23 bp, Homo sapiens
atggtctcctgttctctgcagag

SEQ ID NO: 45374 - DNA, 21 bp, Homo sapiens
tggtctcctgttctctgcaga

SEQ ID NO: 45375 - DNA, 22 bp, Homo sapiens
atggtctcctgttctctgcaga

SEQ ID NO: 45376 - DNA, 20 bp, Homo sapiens
atggtctcctgttctctgca

SEQ ID NO: 45377 - DNA, 18 bp, Homo sapiens
ctcccgtgcctgtgcacc

SEQ ID NO: 45378 - DNA, 19 bp, Homo sapiens
gctcccgtgcctgtgcacc

SEQ ID NO: 45379 - DNA, 20 bp, Homo sapiens
agctcccgtgcctgtgcacc

SEQ ID NO: 45380 - DNA, 22 bp, Homo sapiens
tgagctcccgtgcctgtgcacc

SEQ ID NO: 45381 - DNA, 19 bp, Homo sapiens
agctcccgtgcctgtgcac

SEQ ID NO: 45382 - DNA, 21 bp, Homo sapiens
tgagctcccgtgcctgtgcac

SEQ ID NO: 45383 - DNA, 18 bp, Homo sapiens
agctcccgtgcctgtgca

SEQ ID NO: 45384 - DNA, 19 bp, Homo sapiens
tgagctcccgtgcctgtgc

SEQ ID NO: 45385 - DNA, 22 bp, Homo sapiens
acctgagctcccgtgcctgtgc

SEQ ID NO: 45386 - DNA, 17 bp, Homo sapiens
tgagctcccgtgcctgt

SEQ ID NO: 45387 - DNA, 22 bp, Homo sapiens
tcacctgagctcccgtgcctgt

SEQ ID NO: 45388 - DNA, 22 bp, Homo sapiens
acaggcacgggagctcaggtga

SEQ ID NO: 45389 - DNA, 20 bp, Homo sapiens
caggcacgggagctcaggtg

SEQ ID NO: 45390 - DNA, 21 bp, Homo sapiens
caggcacgggagctcaggtga

SEQ ID NO: 45391 - DNA, 23 bp, Homo sapiens
caggcacgggagctcaggtgagg

SEQ ID NO: 45392 - DNA, 24 bp, Homo sapiens
caggcacgggagctcaggtgaggc

SEQ ID NO: 45393 - DNA, 25 bp, Homo sapiens
caggcacgggagctcaggtgaggca

SEQ ID NO: 45394 - DNA, 24 bp, Homo sapiens
caggcatgggaggtcaggtgagct

SEQ ID NO: 45395 - DNA, 25 bp, Homo sapiens
acaggcatgggaggtcaggtgagct

SEQ ID NO: 45396 - DNA, 23 bp, Homo sapiens
caggcatgggaggtcaggtgagc

SEQ ID NO: 45397 - DNA, 22 bp, Homo sapiens
caggcatgggaggtcaggtgag

SEQ ID NO: 45398 - DNA, 23 bp, Homo sapiens
acaggcatgggaggtcaggtgag

SEQ ID NO: 45399 - DNA, 21 bp, Homo sapiens
caggcatgggaggtcaggtga

SEQ ID NO: 45400 - DNA, 22 bp, Homo sapiens
acaggcatgggaggtcaggtga

SEQ ID NO: 45401 - DNA, 23 bp, Homo sapiens
cacaggcatgggaggtcaggtga

SEQ ID NO: 45402 - DNA, 18 bp, Homo sapiens
cacctgacctcccatgcc

SEQ ID NO: 45403 - DNA, 20 bp, Homo sapiens
cacctgacctcccatgcctg

SEQ ID NO: 45404 - DNA, 21 bp, Homo sapiens
cacctgacctcccatgcctgt

SEQ ID NO: 45405 - DNA, 22 bp, Homo sapiens
cacctgacctcccatgcctgtg

SEQ ID NO: 45406 - DNA, 23 bp, Homo sapiens
cacctgacctcccatgcctgtgc

SEQ ID NO: 45407 - DNA, 24 bp, Homo sapiens
tgcacaggcatgggaggtcaggtg

SEQ ID NO: 45408 - DNA, 24 bp, Homo sapiens
cacctgacctcccatgcctgtgca

SEQ ID NO: 45409 - DNA, 18 bp, Homo sapiens
acctgacctcccatgcct

SEQ ID NO: 45410 - DNA, 20 bp, Homo sapiens
acctgacctcccatgcctgt

SEQ ID NO: 45411 - DNA, 22 bp, Homo sapiens
gcacaggcatgggaggtcaggt

SEQ ID NO: 45412 - DNA, 22 bp, Homo sapiens
acctgacctcccatgcctgtgc

SEQ ID NO: 45413 - DNA, 23 bp, Homo sapiens
acctgacctcccatgcctgtgca

SEQ ID NO: 45414 - DNA, 22 bp, Homo sapiens
tgcacaggcatgggaggtcagg

SEQ ID NO: 45415 - DNA, 23 bp, Homo sapiens
gtgcacaggcatgggaggtcagg

SEQ ID NO: 45416 - DNA, 21 bp, Homo sapiens
tgcacaggcatgggaggtcag

SEQ ID NO: 45417 - DNA, 22 bp, Homo sapiens
gtgcacaggcatgggaggtcag

SEQ ID NO: 45418 - DNA, 20 bp, Homo sapiens
tgcacaggcatgggaggtca

SEQ ID NO: 45419 - DNA, 21 bp, Homo sapiens
gtgcacaggcatgggaggtca

SEQ ID NO: 45420 - DNA, 20 bp, Homo sapiens
gtgcacaggcatgggaggtc

SEQ ID NO: 45421 - DNA, 19 bp, Homo sapiens
gtgcacaggcatgggaggt

SEQ ID NO: 45422 - DNA, 17 bp, Homo sapiens
gtgcacaggcatgggag

SEQ ID NO: 45423 - DNA, 23 bp, Homo sapiens
ttgtctgctgagtttccacgtca

SEQ ID NO: 45424 - DNA, 22 bp, Homo sapiens
gcagtgttgtctgctgagtttc

SEQ ID NO: 45425 - DNA, 25 bp, Homo sapiens
tggaaaaaactggtgtgtgcttatt

SEQ ID NO: 45426 - DNA, 23 bp, Homo sapiens
tggaaaaaactggtgtgtgctta

SEQ ID NO: 45427 - DNA, 21 bp, Homo sapiens
tggaaaaaactggtgtgtgct

SEQ ID NO: 45428 - DNA, 22 bp, Homo sapiens
atggaaaaaactggtgtgtgct

SEQ ID NO: 45429 - DNA, 20 bp, Homo sapiens
tggaaaaaactggtgtgtgc

SEQ ID NO: 45430 - DNA, 24 bp, Homo sapiens
aaagaccgtgactacttttgcaac

SEQ ID NO: 45431 - DNA, 25 bp, Homo sapiens
caaagaccgtgactacttttgcaac

SEQ ID NO: 45432 - DNA, 24 bp, Homo sapiens
caaagaccgtgactacttttgcaa

SEQ ID NO: 45433 - DNA, 21 bp, Homo sapiens
aaagaccgtgactacttttgc

SEQ ID NO: 45434 - DNA, 22 bp, Homo sapiens
caaagaccgtgactacttttgc

SEQ ID NO: 45435 - DNA, 20 bp, Homo sapiens
aaagaccgtgactacttttg

SEQ ID NO: 45436 - DNA, 18 bp, Homo sapiens
aaagaccgtgactacttt

SEQ ID NO: 45437 - DNA, 16 bp, Homo sapiens
aatggcaaagaccgtg

SEQ ID NO: 45438 - DNA, 23 bp, Homo sapiens
agaagtaactacggtttttgcag

SEQ ID NO: 45439 - DNA, 21 bp, Homo sapiens
agaagtaactacggtttttgc

SEQ ID NO: 45440 - DNA, 22 bp, Homo sapiens
cagaagtaactacggtttttgc

SEQ ID NO: 45441 - DNA, 20 bp, Homo sapiens
agaagtaactacggtttttg

SEQ ID NO: 45442 - DNA, 16 bp, Homo sapiens
agaagtaactacggtt

SEQ ID NO: 45443 - DNA, 17 bp, Homo sapiens
cagaagtaactacggtt

SEQ ID NO: 45444 - DNA, 25 bp, Homo sapiens
cggggcagctcagtacaggatactc

SEQ ID NO: 45445 - DNA, 24 bp, Homo sapiens
cggggcagctcagtacaggatact

SEQ ID NO: 45446 - DNA, 22 bp, Homo sapiens
ggggcagctcagtacaggatac

SEQ ID NO: 45447 - DNA, 23 bp, Homo sapiens
cggggcagctcagtacaggatac

SEQ ID NO: 45448 - DNA, 18 bp, Homo sapiens
gcagctcagtacaggata

SEQ ID NO: 45449 - DNA, 19 bp, Homo sapiens
ggcagctcagtacaggata

SEQ ID NO: 45450 - DNA, 21 bp, Homo sapiens
ggggcagctcagtacaggata

SEQ ID NO: 45451 - DNA, 22 bp, Homo sapiens
cggggcagctcagtacaggata

SEQ ID NO: 45452 - DNA, 20 bp, Homo sapiens
cggggcagctcagtacagga

SEQ ID NO: 45453 - DNA, 27 bp, Homo sapiens
tcctgtactgagctgccccgaggccct

SEQ ID NO: 45454 - DNA, 26 bp, Homo sapiens
tcctgtactgagctgccccgaggccc

SEQ ID NO: 45455 - DNA, 25 bp, Homo sapiens
tcctgtactgagctgccccgaggcc

SEQ ID NO: 45456 - DNA, 22 bp, Homo sapiens
ctgtactgagctgccccgaggc

SEQ ID NO: 45457 - DNA, 23 bp, Homo sapiens
cctgtactgagctgccccgaggc

SEQ ID NO: 45458 - DNA, 24 bp, Homo sapiens
tcctgtactgagctgccccgaggc

SEQ ID NO: 45459 - DNA, 21 bp, Homo sapiens
ctgtactgagctgccccgagg

SEQ ID NO: 45460 - DNA, 23 bp, Homo sapiens
tcctgtactgagctgccccgagg

SEQ ID NO: 45461 - DNA, 24 bp, Homo sapiens
gctccctctagggtcgctcggagc

SEQ ID NO: 45462 - DNA, 22 bp, Homo sapiens
ctccctctagggtcgctcggag

SEQ ID NO: 45463 - DNA, 23 bp, Homo sapiens
gctccctctagggtcgctcggag

SEQ ID NO: 45464 - DNA, 21 bp, Homo sapiens
gctccctctagggtcgctcgg

SEQ ID NO: 45465 - DNA, 20 bp, Homo sapiens
gctccctctagggtcgctcg

SEQ ID NO: 45466 - DNA, 22 bp, Homo sapiens
ccgctccctctagggtcgctcg

SEQ ID NO: 45467 - DNA, 22 bp, Homo sapiens
gccgctccctctagggtcgctc

SEQ ID NO: 45468 - DNA, 20 bp, Homo sapiens
ccgctccctctagggtcgct

SEQ ID NO: 45469 - DNA, 21 bp, Homo sapiens
gccgctccctctagggtcgct

SEQ ID NO: 45470 - DNA, 18 bp, Homo sapiens
aacgtggcaaacgtggaa

SEQ ID NO: 45471 - DNA, 22 bp, Homo sapiens
aacgtggcaaacgtggaagccg

SEQ ID NO: 45472 - DNA, 23 bp, Homo sapiens
aacgtggcaaacgtggaagccga

SEQ ID NO: 45473 - DNA, 24 bp, Homo sapiens
aacgtggcaaacgtggaagccgag

SEQ ID NO: 45474 - DNA, 18 bp, Homo sapiens
acgtggcaaacgtggaag

SEQ ID NO: 45475 - DNA, 22 bp, Homo sapiens
acgtggcaaacgtggaagccga

SEQ ID NO: 45476 - DNA, 19 bp, Homo sapiens
gtggcaaacgtggaagccg

SEQ ID NO: 45477 - DNA, 22 bp, Homo sapiens
gtggcaaacgtggaagccgaga

SEQ ID NO: 45478 - DNA, 18 bp, Homo sapiens
tggcaaacgtggaagccg

SEQ ID NO: 45479 - DNA, 19 bp, Homo sapiens
tggcaaacgtggaagccga

SEQ ID NO: 45480 - DNA, 20 bp, Homo sapiens
tggcaaacgtggaagccgag

SEQ ID NO: 45481 - DNA, 22 bp, Homo sapiens
tggcaaacgtggaagccgagag

SEQ ID NO: 45482 - DNA, 23 bp, Homo sapiens
tggcaaacgtggaagccgagagg

SEQ ID NO: 45483 - DNA, 24 bp, Homo sapiens
tggcaaacgtggaagccgagaggg

SEQ ID NO: 45484 - DNA, 22 bp, Homo sapiens
caaacgtggaagccgagagggc

SEQ ID NO: 45485 - DNA, 23 bp, Homo sapiens
caaacgtggaagccgagagggct

SEQ ID NO: 45486 - DNA, 19 bp, Homo sapiens
gtggaagccgagagggctc

SEQ ID NO: 45487 - DNA, 23 bp, Homo sapiens
gcacatgagcagacggagtgatc

SEQ ID NO: 45488 - DNA, 27 bp, Homo sapiens
ttaaggcacgcggtgaatgccaagagc

SEQ ID NO: 45489 - DNA, 26 bp, Homo sapiens
taaggcacgcggtgaatgccaagagc

SEQ ID NO: 45490 - DNA, 25 bp, Homo sapiens
aaggcacgcggtgaatgccaagagc

SEQ ID NO: 45491 - DNA, 26 bp, Homo sapiens
ttcttcttagacatggcagcttcagc

SEQ ID NO: 45492 - DNA, 22 bp, Homo sapiens
ttcttagacatggcagcttcag

SEQ ID NO: 45493 - DNA, 23 bp, Homo sapiens
cttcttagacatggcagcttcag

SEQ ID NO: 45494 - DNA, 24 bp, Homo sapiens
tcttcttagacatggcagcttcag

SEQ ID NO: 45495 - DNA, 22 bp, Homo sapiens
cttcttagacatggcagcttca

SEQ ID NO: 45496 - DNA, 23 bp, Homo sapiens
tcttcttagacatggcagcttca

SEQ ID NO: 45497 - DNA, 24 bp, Homo sapiens
ttcttcttagacatggcagcttca

SEQ ID NO: 45498 - DNA, 22 bp, Homo sapiens
tcttcttagacatggcagcttc

SEQ ID NO: 45499 - DNA, 23 bp, Homo sapiens
ttcttcttagacatggcagcttc

SEQ ID NO: 45500 - DNA, 24 bp, Homo sapiens
tttcttcttagacatggcagcttc

SEQ ID NO: 45501 - DNA, 25 bp, Homo sapiens
ttttcttcttagacatggcagcttc

SEQ ID NO: 45502 - DNA, 23 bp, Homo sapiens
tttcttcttagacatggcagctt

SEQ ID NO: 45503 - DNA, 20 bp, Homo sapiens
agctgccatgtctaagaaga

SEQ ID NO: 45504 - DNA, 22 bp, Homo sapiens
agctgccatgtctaagaagaaa

SEQ ID NO: 45505 - DNA, 23 bp, Homo sapiens
ttttcttcttagacatggcagct

SEQ ID NO: 45506 - DNA, 19 bp, Homo sapiens
gctgccatgtctaagaaga

SEQ ID NO: 45507 - DNA, 20 bp, Homo sapiens
gctgccatgtctaagaagaa

SEQ ID NO: 45508 - DNA, 21 bp, Homo sapiens
gctgccatgtctaagaagaaa

SEQ ID NO: 45509 - DNA, 22 bp, Homo sapiens
ttttcttcttagacatggcagc

SEQ ID NO: 45510 - DNA, 24 bp, Homo sapiens
gctgccatgtctaagaagaaaact

SEQ ID NO: 45511 - DNA, 20 bp, Homo sapiens
ctgccatgtctaagaagaaa

SEQ ID NO: 45512 - DNA, 21 bp, Homo sapiens
ttttcttcttagacatggcag

SEQ ID NO: 45513 - DNA, 21 bp, Homo sapiens
ctgccatgtctaagaagaaaa

SEQ ID NO: 45514 - DNA, 23 bp, Homo sapiens
ctgccatgtctaagaagaaaact

SEQ ID NO: 45515 - DNA, 24 bp, Homo sapiens
ctgccatgtctaagaagaaaactt

SEQ ID NO: 45516 - DNA, 23 bp, Homo sapiens
ttgccatgtctaagaagaaaatt

SEQ ID NO: 45517 - DNA, 24 bp, Homo sapiens
aattttcttcttagacatggcaac

SEQ ID NO: 45518 - DNA, 22 bp, Homo sapiens
ttgccatgtctaagaagaaaat

SEQ ID NO: 45519 - DNA, 21 bp, Homo sapiens
ttttcttcttagacatggcaa

SEQ ID NO: 45520 - DNA, 23 bp, Homo sapiens
ttttcttcttagacatggcaacg

SEQ ID NO: 45521 - DNA, 24 bp, Homo sapiens
acgttgccatgtctaagaagaaaa

SEQ ID NO: 45522 - DNA, 25 bp, Homo sapiens
ttttcttcttagacatggcaacgtc

SEQ ID NO: 45523 - DNA, 28 bp, Homo sapiens
ttttcttcttagacatggcaacgtcaac

SEQ ID NO: 45524 - DNA, 20 bp, Homo sapiens
ttgccatgtctaagaagaaa

SEQ ID NO: 45525 - DNA, 21 bp, Homo sapiens
tttcttcttagacatggcaac

SEQ ID NO: 45526 - DNA, 23 bp, Homo sapiens
acgttgccatgtctaagaagaaa

SEQ ID NO: 45527 - DNA, 23 bp, Homo sapiens
tttcttcttagacatggcaacgt

SEQ ID NO: 45528 - DNA, 24 bp, Homo sapiens
tttcttcttagacatggcaacgtc

SEQ ID NO: 45529 - DNA, 27 bp, Homo sapiens
tttcttcttagacatggcaacgtcaac

SEQ ID NO: 45530 - DNA, 20 bp, Homo sapiens
gttgccatgtctaagaagaa

SEQ ID NO: 45531 - DNA, 21 bp, Homo sapiens
ttcttcttagacatggcaacg

SEQ ID NO: 45532 - DNA, 22 bp, Homo sapiens
acgttgccatgtctaagaagaa

SEQ ID NO: 45533 - DNA, 22 bp, Homo sapiens
ttcttcttagacatggcaacgt

SEQ ID NO: 45534 - DNA, 23 bp, Homo sapiens
ttcttcttagacatggcaacgtc

SEQ ID NO: 45535 - DNA, 24 bp, Homo sapiens
ttcttcttagacatggcaacgtca

SEQ ID NO: 45536 - DNA, 20 bp, Homo sapiens
tcttcttagacatggcaacg

SEQ ID NO: 45537 - DNA, 21 bp, Homo sapiens
acgttgccatgtctaagaaga

SEQ ID NO: 45538 - DNA, 21 bp, Homo sapiens
tcttcttagacatggcaacgt

SEQ ID NO: 45539 - DNA, 23 bp, Homo sapiens
tcttcttagacatggcaacgtca

SEQ ID NO: 45540 - DNA, 22 bp, Homo sapiens
cttcttagacatggcaacgtca

SEQ ID NO: 45541 - DNA, 17 bp, Homo sapiens
ttgacgttgccatgtct

SEQ ID NO: 45542 - DNA, 19 bp, Homo sapiens
agacatggcaacgtcaaca

SEQ ID NO: 45543 - DNA, 22 bp, Homo sapiens
ggtattgccaccctttctagtc

SEQ ID NO: 45544 - DNA, 21 bp, Homo sapiens
aggtattgccaccctttctag

SEQ ID NO: 45545 - DNA, 22 bp, Homo sapiens
tagaaagggtggcaatacctct

SEQ ID NO: 45546 - DNA, 19 bp, Homo sapiens
aggtattgccaccctttct

SEQ ID NO: 45547 - DNA, 20 bp, Homo sapiens
agaaagggtggcaatacctc

SEQ ID NO: 45548 - DNA, 21 bp, Homo sapiens
agaaagggtggcaatacctct

SEQ ID NO: 45549 - DNA, 18 bp, Homo sapiens
aggtattgccaccctttc

SEQ ID NO: 45550 - DNA, 20 bp, Homo sapiens
gaaagggtggcaatacctct

SEQ ID NO: 45551 - DNA, 22 bp, Homo sapiens
gaaagggtggcaatacctcttc

SEQ ID NO: 45552 - DNA, 24 bp, Homo sapiens
aaagggtggcaatacctcttccaa

SEQ ID NO: 45553 - DNA, 19 bp, Homo sapiens
aagggtggcaatacctctt

SEQ ID NO: 45554 - DNA, 19 bp, Homo sapiens
gttgctgttttgataacag

SEQ ID NO: 45555 - DNA, 24 bp, Homo sapiens
tttgtatggatatgtgtgtgtatg

SEQ ID NO: 45556 - DNA, 22 bp, Homo sapiens
tttgtatggatatgtgtgtgta

SEQ ID NO: 45557 - DNA, 21 bp, Homo sapiens
tttgtatggatatgtgtgtgt

SEQ ID NO: 45558 - DNA, 18 bp, Homo sapiens
tatatgtttgtatggata

SEQ ID NO: 45559 - DNA, 21 bp, Homo sapiens
acagacatgagcgactgtgcc

SEQ ID NO: 45560 - DNA, 22 bp, Homo sapiens
acagacatgagcgactgtgcct

SEQ ID NO: 45561 - DNA, 23 bp, Homo sapiens
agacatgagcgactgtgcctgac

SEQ ID NO: 45562 - DNA, 21 bp, Homo sapiens
acatgagcgactgtgcctgac

SEQ ID NO: 45563 - DNA, 22 bp, Homo sapiens
acatgagcgactgtgcctgacc

SEQ ID NO: 45564 - DNA, 21 bp, Homo sapiens
tgagcgactgtgcctgaccaa

SEQ ID NO: 45565 - DNA, 20 bp, Homo sapiens
tgcagctctggtggaaaatg

SEQ ID NO: 45566 - DNA, 21 bp, Homo sapiens
tgcagctctggtggaaaatgg

SEQ ID NO: 45567 - DNA, 22 bp, Homo sapiens
tgcagctctggtggaaaatgga

SEQ ID NO: 45568 - DNA, 24 bp, Homo sapiens
tgcagctctggtggaaaatggaga

SEQ ID NO: 45569 - DNA, 25 bp, Homo sapiens
tgcagctctggtggaaaatggagaa

SEQ ID NO: 45570 - DNA, 22 bp, Homo sapiens
gcagctctggtggaaaatggag

SEQ ID NO: 45571 - DNA, 19 bp, Homo sapiens
aactagctctgtggatcct

SEQ ID NO: 45572 - DNA, 20 bp, Homo sapiens
aactagctctgtggatcctg

SEQ ID NO: 45573 - DNA, 21 bp, Homo sapiens
aactagctctgtggatcctga

SEQ ID NO: 45574 - DNA, 23 bp, Homo sapiens
aactagctctgtggatcctgaca

SEQ ID NO: 45575 - DNA, 26 bp, Homo sapiens
aactagctctgtggatcctgacagac

SEQ ID NO: 45576 - DNA, 26 bp, Homo sapiens
atagacaggatccacagagctagtcc

SEQ ID NO: 45577 - DNA, 20 bp, Homo sapiens
caggatccacagagctagtc

SEQ ID NO: 45578 - DNA, 21 bp, Homo sapiens
caggatccacagagctagtcc

SEQ ID NO: 45579 - DNA, 19 bp, Homo sapiens
aggatccacagagctagtc

SEQ ID NO: 45580 - DNA, 20 bp, Homo sapiens
aggatccacagagctagtcc

SEQ ID NO: 45581 - DNA, 21 bp, Homo sapiens
aggatccacagagctagtcca

SEQ ID NO: 45582 - DNA, 18 bp, Homo sapiens
agagctagtccagagtaa

SEQ ID NO: 45583 - DNA, 17 bp, Homo sapiens
aaaaatcagtatggatt

SEQ ID NO: 45584 - DNA, 25 bp, Homo sapiens
ctggacttggagtcagaaaactttc

SEQ ID NO: 45585 - DNA, 26 bp, Homo sapiens
actggacttggagtcagaaaactttc

SEQ ID NO: 45586 - DNA, 23 bp, Homo sapiens
ctggacttggagtcagaaaactt

SEQ ID NO: 45587 - DNA, 24 bp, Homo sapiens
actggacttggagtcagaaaactt

SEQ ID NO: 45588 - DNA, 22 bp, Homo sapiens
ctggacttggagtcagaaaact

SEQ ID NO: 45589 - DNA, 23 bp, Homo sapiens
actggacttggagtcagaaaact

SEQ ID NO: 45590 - DNA, 21 bp, Homo sapiens
ctggacttggagtcagaaaac

SEQ ID NO: 45591 - DNA, 22 bp, Homo sapiens
actggacttggagtcagaaaac

SEQ ID NO: 45592 - DNA, 18 bp, Homo sapiens
tgtgtgtcactcgatgac

SEQ ID NO: 45593 - DNA, 19 bp, Homo sapiens
tgtgtgtcactcgatgacc

SEQ ID NO: 45594 - DNA, 20 bp, Homo sapiens
tgtgtgtcactcgatgacca

SEQ ID NO: 45595 - DNA, 23 bp, Homo sapiens
tgtgtgtcactcgatgaccactg

SEQ ID NO: 45596 - DNA, 21 bp, Homo sapiens
gtgtgtcactcgatgaccact

SEQ ID NO: 45597 - DNA, 23 bp, Homo sapiens
gtgtgtcactcgatgaccactgt

SEQ ID NO: 45598 - DNA, 16 bp, Homo sapiens
tgtgtcactcgatgac

SEQ ID NO: 45599 - DNA, 18 bp, Homo sapiens
tgtgtcactcgatgacca

SEQ ID NO: 45600 - DNA, 19 bp, Homo sapiens
tgtgtcactcgatgaccac

SEQ ID NO: 45601 - DNA, 21 bp, Homo sapiens
tgtgtcactcgatgaccactg

SEQ ID NO: 45602 - DNA, 23 bp, Homo sapiens
tgtgtcactcgatgaccactgtg

SEQ ID NO: 45603 - DNA, 24 bp, Homo sapiens
tgtgtcactcgatgaccactgtga

SEQ ID NO: 45604 - DNA, 21 bp, Homo sapiens
gtgtcactcgatgaccactgt

SEQ ID NO: 45605 - DNA, 18 bp, Homo sapiens
tcactcgatgaccactgt

SEQ ID NO: 45606 - DNA, 23 bp, Homo sapiens
cagtggttctcttgtggctcaag

SEQ ID NO: 45607 - DNA, 18 bp, Homo sapiens
agtggttctcttgtggct

SEQ ID NO: 45608 - DNA, 19 bp, Homo sapiens
agtggttctcttgtggctc

SEQ ID NO: 45609 - DNA, 20 bp, Homo sapiens
agtggttctcttgtggctca

SEQ ID NO: 45610 - DNA, 21 bp, Homo sapiens
agtggttctcttgtggctcaa

SEQ ID NO: 45611 - DNA, 22 bp, Homo sapiens
agtggttctcttgtggctcaag

SEQ ID NO: 45612 - DNA, 23 bp, Homo sapiens
agtggttctcttgtggctcaagc

SEQ ID NO: 45613 - DNA, 24 bp, Homo sapiens
agtggttctcttgtggctcaagcg

SEQ ID NO: 45614 - DNA, 22 bp, Homo sapiens
gtggttctcttgtggctcaagc

SEQ ID NO: 45615 - DNA, 23 bp, Homo sapiens
gtggttctcttgtggctcaagcg

SEQ ID NO: 45616 - DNA, 19 bp, Homo sapiens
tggttctcttgtggctcaa

SEQ ID NO: 45617 - DNA, 21 bp, Homo sapiens
tggttctcttgtggctcaagc

SEQ ID NO: 45618 - DNA, 22 bp, Homo sapiens
tggttctcttgtggctcaagcg

SEQ ID NO: 45619 - DNA, 26 bp, Homo sapiens
ggttctcttgtggctcaagcgtaatg

SEQ ID NO: 45620 - DNA, 24 bp, Homo sapiens
ggagatcgtcgaggttggcctgct

SEQ ID NO: 45621 - DNA, 19 bp, Homo sapiens
gcaggccaacctcgacgat

SEQ ID NO: 45622 - DNA, 21 bp, Homo sapiens
agatcgtcgaggttggcctgc

SEQ ID NO: 45623 - DNA, 21 bp, Homo sapiens
gcaggccaacctcgacgatct

SEQ ID NO: 45624 - DNA, 23 bp, Homo sapiens
ggagatcgtcgaggttggcctgc

SEQ ID NO: 45625 - DNA, 25 bp, Homo sapiens
gaggagatcgtcgaggttggcctgc

SEQ ID NO: 45626 - DNA, 22 bp, Homo sapiens
caggccaacctcgacgatctcc

SEQ ID NO: 45627 - DNA, 24 bp, Homo sapiens
gaggagatcgtcgaggttggcctg

SEQ ID NO: 45628 - DNA, 25 bp, Homo sapiens
tgaggagatcgtcgaggttggcctg

SEQ ID NO: 45629 - DNA, 23 bp, Homo sapiens
gaggagatcgtcgaggttggcct

SEQ ID NO: 45630 - DNA, 24 bp, Homo sapiens
tgaggagatcgtcgaggttggcct

SEQ ID NO: 45631 - DNA, 22 bp, Homo sapiens
gaggagatcgtcgaggttggcc

SEQ ID NO: 45632 - DNA, 23 bp, Homo sapiens
tgaggagatcgtcgaggttggcc

SEQ ID NO: 45633 - DNA, 21 bp, Homo sapiens
gaggagatcgtcgaggttggc

SEQ ID NO: 45634 - DNA, 22 bp, Homo sapiens
tgaggagatcgtcgaggttggc

SEQ ID NO: 45635 - DNA, 20 bp, Homo sapiens
gaggagatcgtcgaggttgg

SEQ ID NO: 45636 - DNA, 22 bp, Homo sapiens
ctgaggagatcgtcgaggttgg

SEQ ID NO: 45637 - DNA, 22 bp, Homo sapiens
ccaacctcgacgatctcctcag

SEQ ID NO: 45638 - DNA, 26 bp, Homo sapiens
ccaacctcgacgatctcctcagcacc

SEQ ID NO: 45639 - DNA, 20 bp, Homo sapiens
tgaggagatcgtcgaggttg

SEQ ID NO: 45640 - DNA, 20 bp, Homo sapiens
caacctcgacgatctcctca

SEQ ID NO: 45641 - DNA, 21 bp, Homo sapiens
caacctcgacgatctcctcag

SEQ ID NO: 45642 - DNA, 23 bp, Homo sapiens
tgctgaggagatcgtcgaggttg

SEQ ID NO: 45643 - DNA, 23 bp, Homo sapiens
caacctcgacgatctcctcagca

SEQ ID NO: 45644 - DNA, 24 bp, Homo sapiens
caacctcgacgatctcctcagcac

SEQ ID NO: 45645 - DNA, 25 bp, Homo sapiens
caacctcgacgatctcctcagcacc

SEQ ID NO: 45646 - DNA, 19 bp, Homo sapiens
tgaggagatcgtcgaggtt

SEQ ID NO: 45647 - DNA, 20 bp, Homo sapiens
aacctcgacgatctcctcag

SEQ ID NO: 45648 - DNA, 21 bp, Homo sapiens
aacctcgacgatctcctcagc

SEQ ID NO: 45649 - DNA, 22 bp, Homo sapiens
aacctcgacgatctcctcagca

SEQ ID NO: 45650 - DNA, 23 bp, Homo sapiens
aacctcgacgatctcctcagcac

SEQ ID NO: 45651 - DNA, 24 bp, Homo sapiens
aacctcgacgatctcctcagcacc

SEQ ID NO: 45652 - DNA, 18 bp, Homo sapiens
tgaggagatcgtcgaggt

SEQ ID NO: 45653 - DNA, 16 bp, Homo sapiens
gaggagatcgtcgagg

SEQ ID NO: 45654 - DNA, 17 bp, Homo sapiens
tgaggagatcgtcgagg

SEQ ID NO: 45655 - DNA, 20 bp, Homo sapiens
acgatctcctcagcacctga

SEQ ID NO: 45656 - DNA, 26 bp, Homo sapiens
aacctcgaggatctccccagccttgg

SEQ ID NO: 45657 - DNA, 25 bp, Homo sapiens
aacctcgaggatctccccagccttg

SEQ ID NO: 45658 - DNA, 24 bp, Homo sapiens
aacctcgaggatctccccagcctt

SEQ ID NO: 45659 - DNA, 23 bp, Homo sapiens
aacctcgaggatctccccagcct

SEQ ID NO: 45660 - DNA, 24 bp, Homo sapiens
caacctcgaggatctccccagcct

SEQ ID NO: 45661 - DNA, 22 bp, Homo sapiens
aacctcgaggatctccccagcc

SEQ ID NO: 45662 - DNA, 23 bp, Homo sapiens
caacctcgaggatctccccagcc

SEQ ID NO: 45663 - DNA, 24 bp, Homo sapiens
ccaacctcgaggatctccccagcc

SEQ ID NO: 45664 - DNA, 21 bp, Homo sapiens
aacctcgaggatctccccagc

SEQ ID NO: 45665 - DNA, 23 bp, Homo sapiens
ccaacctcgaggatctccccagc

SEQ ID NO: 45666 - DNA, 20 bp, Homo sapiens
aacctcgaggatctccccag

SEQ ID NO: 45667 - DNA, 21 bp, Homo sapiens
ctggggagatcctcgaggttg

SEQ ID NO: 45668 - DNA, 21 bp, Homo sapiens
tggggagatcctcgaggttgg

SEQ ID NO: 45669 - DNA, 22 bp, Homo sapiens
tggggagatcctcgaggttggc

SEQ ID NO: 45670 - DNA, 23 bp, Homo sapiens
tggggagatcctcgaggttggcc

SEQ ID NO: 45671 - DNA, 20 bp, Homo sapiens
ccaacctcgaggatctcccc

SEQ ID NO: 45672 - DNA, 23 bp, Homo sapiens
ggagatcctcgaggttggcctgc

SEQ ID NO: 45673 - DNA, 20 bp, Homo sapiens
gagatcctcgaggttggcct

SEQ ID NO: 45674 - DNA, 22 bp, Homo sapiens
gagatcctcgaggttggcctgc

SEQ ID NO: 45675 - DNA, 23 bp, Homo sapiens
gagatcctcgaggttggcctgct

SEQ ID NO: 45676 - DNA, 21 bp, Homo sapiens
gatcctcgaggttggcctgct

SEQ ID NO: 45677 - DNA, 20 bp, Homo sapiens
atcctcgaggttggcctgct

SEQ ID NO: 45678 - DNA, 25 bp, Homo sapiens
aaggcacgcggtgaatgccaagaat

SEQ ID NO: 45679 - DNA, 26 bp, Homo sapiens
taaggcacgcggtgaatgccaagaat

SEQ ID NO: 45680 - DNA, 25 bp, Homo sapiens
taaggcacgcggtgaatgccaagaa

SEQ ID NO: 45681 - DNA, 20 bp, Homo sapiens
aaggcacgcggtgaatgcca

SEQ ID NO: 45682 - DNA, 21 bp, Homo sapiens
taaggcacgcggtgaatgcca

SEQ ID NO: 45683 - DNA, 27 bp, Homo sapiens
cgtgttcacagcggaccttgatttaaa

SEQ ID NO: 45684 - DNA, 21 bp, Homo sapiens
cgtgttcacagcggaccttga

SEQ ID NO: 45685 - DNA, 20 bp, Homo sapiens
cgtgttcacagcggaccttg

SEQ ID NO: 45686 - DNA, 23 bp, Homo sapiens
tgcgtttctcctcttgagcaggg

SEQ ID NO: 45687 - DNA, 22 bp, Homo sapiens
tgcgtttctcctcttgagcagg

SEQ ID NO: 45688 - DNA, 20 bp, Homo sapiens
tgcgtttctcctcttgagca

SEQ ID NO: 45689 - DNA, 19 bp, Homo sapiens
tgcgtttctcctcttgagc

SEQ ID NO: 45690 - DNA, 19 bp, Homo sapiens
tgagaactgctgatgtcat

SEQ ID NO: 45691 - DNA, 25 bp, Homo sapiens
agctcaggtttgagaactgctgatg

SEQ ID NO: 45692 - DNA, 26 bp, Homo sapiens
aagctcaggtttgagaactgctgatg

SEQ ID NO: 45693 - DNA, 27 bp, Homo sapiens
caagctcaggtttgagaactgctgatg

SEQ ID NO: 45694 - DNA, 21 bp, Homo sapiens
ctcaggtttgagaactgctga

SEQ ID NO: 45695 - DNA, 23 bp, Homo sapiens
agctcaggtttgagaactgctga

SEQ ID NO: 45696 - DNA, 22 bp, Homo sapiens
agctcaggtttgagaactgctg

SEQ ID NO: 45697 - DNA, 23 bp, Homo sapiens
aagctcaggtttgagaactgctg

SEQ ID NO: 45698 - DNA, 22 bp, Homo sapiens
aagctcaggtttgagaactgct

SEQ ID NO: 45699 - DNA, 23 bp, Homo sapiens
caagctcaggtttgagaactgct

SEQ ID NO: 45700 - DNA, 19 bp, Homo sapiens
gctcaggtttgagaactgc

SEQ ID NO: 45701 - DNA, 21 bp, Homo sapiens
aagctcaggtttgagaactgc

SEQ ID NO: 45702 - DNA, 22 bp, Homo sapiens
caagctcaggtttgagaactgc

SEQ ID NO: 45703 - DNA, 19 bp, Homo sapiens
aagctcaggtttgagaact

SEQ ID NO: 45704 - DNA, 27 bp, Homo sapiens
caatttagtgtgtgtgatattttcaca

SEQ ID NO: 45705 - DNA, 26 bp, Homo sapiens
caatttagtgtgtgtgatattttcac

SEQ ID NO: 45706 - DNA, 24 bp, Homo sapiens
caatttagtgtgtgtgatattttc

SEQ ID NO: 45707 - DNA, 25 bp, Homo sapiens
gcaatttagtgtgtgtgatattttc

SEQ ID NO: 45708 - DNA, 23 bp, Homo sapiens
caatttagtgtgtgtgatatttt

SEQ ID NO: 45709 - DNA, 24 bp, Homo sapiens
gcaatttagtgtgtgtgatatttt

SEQ ID NO: 45710 - DNA, 21 bp, Homo sapiens
caatttagtgtgtgtgatatt

SEQ ID NO: 45711 - DNA, 22 bp, Homo sapiens
gcaatttagtgtgtgtgatatt

SEQ ID NO: 45712 - DNA, 20 bp, Homo sapiens
caatttagtgtgtgtgatat

SEQ ID NO: 45713 - DNA, 22 bp, Homo sapiens
tgcaatttagtgtgtgtgatat

SEQ ID NO: 45714 - DNA, 23 bp, Homo sapiens
atgcaatttagtgtgtgtgatat

SEQ ID NO: 45715 - DNA, 19 bp, Homo sapiens
caatttagtgtgtgtgata

SEQ ID NO: 45716 - DNA, 21 bp, Homo sapiens
tgcaatttagtgtgtgtgata

SEQ ID NO: 45717 - DNA, 22 bp, Homo sapiens
atgcaatttagtgtgtgtgata

SEQ ID NO: 45718 - DNA, 21 bp, Homo sapiens
atgcaatttagtgtgtgtgat

SEQ ID NO: 45719 - DNA, 17 bp, Homo sapiens
caatttagtgtgtgtga

SEQ ID NO: 45720 - DNA, 20 bp, Homo sapiens
atgcaatttagtgtgtgtga

SEQ ID NO: 45721 - DNA, 27 bp, Homo sapiens
tattgcacattactaagttgcatgttg

SEQ ID NO: 45722 - DNA, 20 bp, Homo sapiens
gcacattactaagttgcatg

SEQ ID NO: 45723 - DNA, 24 bp, Homo sapiens
tattgcacattactaagttgcatg

SEQ ID NO: 45724 - DNA, 25 bp, Homo sapiens
atattgcacattactaagttgcatg

SEQ ID NO: 45725 - DNA, 23 bp, Homo sapiens
tattgcacattactaagttgcat

SEQ ID NO: 45726 - DNA, 21 bp, Homo sapiens
attgcacattactaagttgca

SEQ ID NO: 45727 - DNA, 20 bp, Homo sapiens
attgcacattactaagttgc

SEQ ID NO: 45728 - DNA, 21 bp, Homo sapiens
tattgcacattactaagttgc

SEQ ID NO: 45729 - DNA, 20 bp, Homo sapiens
tattgcacattactaagttg

SEQ ID NO: 45730 - DNA, 19 bp, Homo sapiens
tattgcacattactaagtt

SEQ ID NO: 45731 - DNA, 18 bp, Homo sapiens
tattgcacattactaagt

SEQ ID NO: 45732 - DNA, 23 bp, Homo sapiens
aggtagatatttgataggcattg

SEQ ID NO: 45733 - DNA, 24 bp, Homo sapiens
caggtagatatttgataggcattg

SEQ ID NO: 45734 - DNA, 23 bp, Homo sapiens
caggtagatatttgataggcatt

SEQ ID NO: 45735 - DNA, 24 bp, Homo sapiens
cttagactgccagactccctgagg

SEQ ID NO: 45736 - DNA, 23 bp, Homo sapiens
cttagactgccagactccctgag

SEQ ID NO: 45737 - DNA, 21 bp, Homo sapiens
cttagactgccagactccctg

SEQ ID NO: 45738 - DNA, 19 bp, Homo sapiens
cttagactgccagactccc

SEQ ID NO: 45739 - DNA, 20 bp, Homo sapiens
tcttagactgccagactccc

SEQ ID NO: 45740 - DNA, 22 bp, Homo sapiens
gccactcttagactgccagact

SEQ ID NO: 45741 - DNA, 19 bp, Homo sapiens
tatttgagggaaaaaaaaa

SEQ ID NO: 45742 - DNA, 20 bp, Homo sapiens
tatttgagggaaaaaaaaaa

SEQ ID NO: 45743 - DNA, 21 bp, Homo sapiens
tatttgagggaaaaaaaaaag

SEQ ID NO: 45744 - DNA, 25 bp, Homo sapiens
tgagggaaaaaaaaaaggatttgtc

SEQ ID NO: 45745 - DNA, 20 bp, Homo sapiens
agggaaaaaaaaaaggattt

SEQ ID NO: 45746 - DNA, 21 bp, Homo sapiens
agggaaaaaaaaaaggatttg

SEQ ID NO: 45747 - DNA, 22 bp, Homo sapiens
agggaaaaaaaaaaggatttgt

SEQ ID NO: 45748 - DNA, 21 bp, Homo sapiens
gggaaaaaaaaaaggatttgt

SEQ ID NO: 45749 - DNA, 24 bp, Homo sapiens
gggaaaaaaaaaaggatttgtctt

SEQ ID NO: 45750 - DNA, 19 bp, Homo sapiens
gaaaatcctttttgttttt

SEQ ID NO: 45751 - DNA, 20 bp, Homo sapiens
gaaaatcctttttgtttttc

SEQ ID NO: 45752 - DNA, 22 bp, Homo sapiens
gaaaatcctttttgtttttcca

SEQ ID NO: 45753 - DNA, 24 bp, Homo sapiens
gaaaatcctttttgtttttccagg

SEQ ID NO: 45754 - DNA, 25 bp, Homo sapiens
gaaaatcctttttgtttttccaggt

SEQ ID NO: 45755 - DNA, 21 bp, Homo sapiens
aaaatcctttttgtttttcca

SEQ ID NO: 45756 - DNA, 22 bp, Homo sapiens
aaaatcctttttgtttttccag

SEQ ID NO: 45757 - DNA, 23 bp, Homo sapiens
aaaatcctttttgtttttccagg

SEQ ID NO: 45758 - DNA, 22 bp, Homo sapiens
aaatcctttttgtttttccagg

SEQ ID NO: 45759 - DNA, 16 bp, Homo sapiens
gtatgtgcctttggac

SEQ ID NO: 45760 - DNA, 20 bp, Homo sapiens
gtatgtgcctttggactaca

SEQ ID NO: 45761 - DNA, 21 bp, Homo sapiens
gtatgtgcctttggactacat

SEQ ID NO: 45762 - DNA, 22 bp, Homo sapiens
gtatgtgcctttggactacatc

SEQ ID NO: 45763 - DNA, 23 bp, Homo sapiens
gtatgtgcctttggactacatcg

SEQ ID NO: 45764 - DNA, 17 bp, Homo sapiens
tatgtgcctttggacta

SEQ ID NO: 45765 - DNA, 19 bp, Homo sapiens
tatgtgcctttggactaca

SEQ ID NO: 45766 - DNA, 20 bp, Homo sapiens
tatgtgcctttggactacat

SEQ ID NO: 45767 - DNA, 21 bp, Homo sapiens
tatgtgcctttggactacatc

SEQ ID NO: 45768 - DNA, 23 bp, Homo sapiens
tatgtgcctttggactacatcgt

SEQ ID NO: 45769 - DNA, 22 bp, Homo sapiens
atgtgcctttggactacatcgt

SEQ ID NO: 45770 - DNA, 20 bp, Homo sapiens
tgtgcctttggactacatcg

SEQ ID NO: 45771 - DNA, 21 bp, Homo sapiens
tgtgcctttggactacatcgt

SEQ ID NO: 45772 - DNA, 22 bp, Homo sapiens
tgtgcctttggactacatcgtg

SEQ ID NO: 45773 - DNA, 23 bp, Homo sapiens
tgtgcctttggactacatcgtgg

SEQ ID NO: 45774 - DNA, 18 bp, Homo sapiens
atgcagtccatgggcata

SEQ ID NO: 45775 - DNA, 19 bp, Homo sapiens
atgcagtccatgggcatat

SEQ ID NO: 45776 - DNA, 20 bp, Homo sapiens
atgcagtccatgggcatata

SEQ ID NO: 45777 - DNA, 21 bp, Homo sapiens
atgcagtccatgggcatatac

SEQ ID NO: 45778 - DNA, 22 bp, Homo sapiens
atgcagtccatgggcatataca

SEQ ID NO: 45779 - DNA, 23 bp, Homo sapiens
atgcagtccatgggcatatacac

SEQ ID NO: 45780 - DNA, 23 bp, Homo sapiens
tgcagtccatgggcatatacact

SEQ ID NO: 45781 - DNA, 18 bp, Homo sapiens
gcagtccatgggcatata

SEQ ID NO: 45782 - DNA, 20 bp, Homo sapiens
gcagtccatgggcatataca

SEQ ID NO: 45783 - DNA, 22 bp, Homo sapiens
gcagtccatgggcatatacact

SEQ ID NO: 45784 - DNA, 23 bp, Homo sapiens
gcagtccatgggcatatacactt

SEQ ID NO: 45785 - DNA, 24 bp, Homo sapiens
gcagtccatgggcatatacacttg

SEQ ID NO: 45786 - DNA, 21 bp, Homo sapiens
cagtccatgggcatatacact

SEQ ID NO: 45787 - DNA, 22 bp, Homo sapiens
cagtccatgggcatatacactt

SEQ ID NO: 45788 - DNA, 25 bp, Homo sapiens
gtgtgtggaaatgcttctgctagat

SEQ ID NO: 45789 - DNA, 23 bp, Homo sapiens
gtgtgtggaaatgcttctgctag

SEQ ID NO: 45790 - DNA, 22 bp, Homo sapiens
gtgtgtggaaatgcttctgcta

SEQ ID NO: 45791 - DNA, 21 bp, Homo sapiens
gtgtgtggaaatgcttctgct

SEQ ID NO: 45792 - DNA, 19 bp, Homo sapiens
gtgtgtggaaatgcttctg

SEQ ID NO: 45793 - DNA, 19 bp, Homo sapiens
aggctgagctgaggagcct

SEQ ID NO: 45794 - DNA, 18 bp, Homo sapiens
gaggctgagctgaggagc

SEQ ID NO: 45795 - DNA, 22 bp, Homo sapiens
cagacaagagccttgctcaggc

SEQ ID NO: 45796 - DNA, 23 bp, Homo sapiens
acagacaagagccttgctcaggc

SEQ ID NO: 45797 - DNA, 22 bp, Homo sapiens
acagacaagagccttgctcagg

SEQ ID NO: 45798 - DNA, 23 bp, Homo sapiens
tacagacaagagccttgctcagg

SEQ ID NO: 45799 - DNA, 24 bp, Homo sapiens
ttacagacaagagccttgctcagg

SEQ ID NO: 45800 - DNA, 21 bp, Homo sapiens
acagacaagagccttgctcag

SEQ ID NO: 45801 - DNA, 22 bp, Homo sapiens
tacagacaagagccttgctcag

SEQ ID NO: 45802 - DNA, 23 bp, Homo sapiens
ttacagacaagagccttgctcag

SEQ ID NO: 45803 - DNA, 22 bp, Homo sapiens
acttacagacaagagccttgct

SEQ ID NO: 45804 - DNA, 23 bp, Homo sapiens
tacttacagacaagagccttgct

SEQ ID NO: 45805 - DNA, 21 bp, Homo sapiens
acttacagacaagagccttgc

SEQ ID NO: 45806 - DNA, 22 bp, Homo sapiens
tacttacagacaagagccttgc

SEQ ID NO: 45807 - DNA, 18 bp, Homo sapiens
ttacagacaagagccttg

SEQ ID NO: 45808 - DNA, 20 bp, Homo sapiens
acttacagacaagagccttg

SEQ ID NO: 45809 - DNA, 21 bp, Homo sapiens
tacttacagacaagagccttg

SEQ ID NO: 45810 - DNA, 17 bp, Homo sapiens
aggaacattcaacgctg

SEQ ID NO: 45811 - DNA, 23 bp, Homo sapiens
aggaacattcaacgctgtcggtg

SEQ ID NO: 45812 - DNA, 24 bp, Homo sapiens
aggaacattcaacgctgtcggtga

SEQ ID NO: 45813 - DNA, 26 bp, Homo sapiens
aggaacattcaacgctgtcggtgagt

SEQ ID NO: 45814 - DNA, 20 bp, Homo sapiens
ggaacattcaacgctgtcgg

SEQ ID NO: 45815 - DNA, 24 bp, Homo sapiens
ggaacattcaacgctgtcggtgag

SEQ ID NO: 45816 - DNA, 25 bp, Homo sapiens
ggaacattcaacgctgtcggtgagt

SEQ ID NO: 45817 - DNA, 26 bp, Homo sapiens
ggaacattcaacgctgtcggtgagtt

SEQ ID NO: 45818 - DNA, 16 bp, Homo sapiens
aacattcaacgctgtc

SEQ ID NO: 45819 - DNA, 18 bp, Homo sapiens
aacattcaacgctgtcgg

SEQ ID NO: 45820 - DNA, 21 bp, Homo sapiens
aacattcaacgctgtcggtga

SEQ ID NO: 45821 - DNA, 22 bp, Homo sapiens
aacattcaacgctgtcggtgag

SEQ ID NO: 45822 - DNA, 24 bp, Homo sapiens
aacattcaacgctgtcggtgagtt

SEQ ID NO: 45823 - DNA, 28 bp, Homo sapiens
aacattcaacgctgtcggtgagtttggg

SEQ ID NO: 45824 - DNA, 22 bp, Homo sapiens
acattcaacgctgtcggtgagt

SEQ ID NO: 45825 - DNA, 27 bp, Homo sapiens
acattcaacgctgtcggtgagtttggg

SEQ ID NO: 45826 - DNA, 27 bp, Homo sapiens
cattcaacgctgtcggtgagtttggga

SEQ ID NO: 45827 - DNA, 17 bp, Homo sapiens
accactgaccgttgact

SEQ ID NO: 45828 - DNA, 18 bp, Homo sapiens
accactgaccgttgactg

SEQ ID NO: 45829 - DNA, 19 bp, Homo sapiens
accactgaccgttgactgt

SEQ ID NO: 45830 - DNA, 20 bp, Homo sapiens
accactgaccgttgactgta

SEQ ID NO: 45831 - DNA, 21 bp, Homo sapiens
accactgaccgttgactgtac

SEQ ID NO: 45832 - DNA, 23 bp, Homo sapiens
accactgaccgttgactgtacct

SEQ ID NO: 45833 - DNA, 24 bp, Homo sapiens
accactgaccgttgactgtacctt

SEQ ID NO: 45834 - DNA, 27 bp, Homo sapiens
accactgaccgttgactgtaccttggg

SEQ ID NO: 45835 - DNA, 22 bp, Homo sapiens
actgaccgttgactgtaccttg

SEQ ID NO: 45836 - DNA, 20 bp, Homo sapiens
tgaccgttgactgtaccttg

SEQ ID NO: 45837 - DNA, 26 bp, Homo sapiens
caacattcattgctgtcggtgggttt

SEQ ID NO: 45838 - DNA, 25 bp, Homo sapiens
aacattcattgctgtcggtgggttt

SEQ ID NO: 45839 - DNA, 26 bp, Homo sapiens
aacattcattgctgtcggtgggtttg

SEQ ID NO: 45840 - DNA, 27 bp, Homo sapiens
aacattcattgctgtcggtgggtttga

SEQ ID NO: 45841 - DNA, 28 bp, Homo sapiens
aacattcattgctgtcggtgggtttgag

SEQ ID NO: 45842 - DNA, 24 bp, Homo sapiens
acattcattgctgtcggtgggttt

SEQ ID NO: 45843 - DNA, 25 bp, Homo sapiens
tgtgtggatcctggaggaggcagag

SEQ ID NO: 45844 - DNA, 24 bp, Homo sapiens
tgtgtggatcctggaggaggcaga

SEQ ID NO: 45845 - DNA, 23 bp, Homo sapiens
tgtgtggatcctggaggaggcag

SEQ ID NO: 45846 - DNA, 21 bp, Homo sapiens
tgtgtggatcctggaggaggc

SEQ ID NO: 45847 - DNA, 20 bp, Homo sapiens
tgtgtggatcctggaggagg

SEQ ID NO: 45848 - DNA, 19 bp, Homo sapiens
tgtgtggatcctggaggag

SEQ ID NO: 45849 - DNA, 24 bp, Homo sapiens
gtggcggcggcggaggcgggggca

SEQ ID NO: 45850 - DNA, 21 bp, Homo sapiens
cggcggcggaggcgggggcag

SEQ ID NO: 45851 - DNA, 22 bp, Homo sapiens
cggcggcggaggcgggggcagc

SEQ ID NO: 45852 - DNA, 21 bp, Homo sapiens
cggcggaggcgggggcagcgg

SEQ ID NO: 45853 - DNA, 20 bp, Homo sapiens
ctggcggtgggcggcgggcg

SEQ ID NO: 45854 - DNA, 18 bp, Homo sapiens
ggcggtgggcggcgggcg

SEQ ID NO: 45855 - DNA, 26 bp, Homo sapiens
tacacagctggacagaggcacgaaac

SEQ ID NO: 45856 - DNA, 27 bp, Homo sapiens
ttacacagctggacagaggcacgaaac

SEQ ID NO: 45857 - DNA, 23 bp, Homo sapiens
tacacagctggacagaggcacga

SEQ ID NO: 45858 - DNA, 24 bp, Homo sapiens
ttacacagctggacagaggcacga

SEQ ID NO: 45859 - DNA, 23 bp, Homo sapiens
ttacacagctggacagaggcacg

SEQ ID NO: 45860 - DNA, 22 bp, Homo sapiens
ttacacagctggacagaggcac

SEQ ID NO: 45861 - DNA, 19 bp, Homo sapiens
ttacacagctggacagagg

SEQ ID NO: 45862 - DNA, 20 bp, Homo sapiens
tcttggttacacagctggac

SEQ ID NO: 45863 - DNA, 27 bp, Homo sapiens
attgtacagtagtctgcacattggtta

SEQ ID NO: 45864 - DNA, 28 bp, Homo sapiens
aattgtacagtagtctgcacattggtta

SEQ ID NO: 45865 - DNA, 22 bp, Homo sapiens
tacagtagtctgcacattggtt

SEQ ID NO: 45866 - DNA, 26 bp, Homo sapiens
attgtacagtagtctgcacattggtt

SEQ ID NO: 45867 - DNA, 21 bp, Homo sapiens
aattgtacagtagtctgcaca

SEQ ID NO: 45868 - DNA, 27 bp, Homo sapiens
cccagtgtttagactatctgttcagga

SEQ ID NO: 45869 - DNA, 25 bp, Homo sapiens
cccagtgtttagactatctgttcag

SEQ ID NO: 45870 - DNA, 24 bp, Homo sapiens
cccagtgtttagactatctgttca

SEQ ID NO: 45871 - DNA, 22 bp, Homo sapiens
cccagtgtttagactatctgtt

SEQ ID NO: 45872 - DNA, 21 bp, Homo sapiens
cccagtgtttagactatctgt

SEQ ID NO: 45873 - DNA, 20 bp, Homo sapiens
cccagtgtttagactatctg

SEQ ID NO: 45874 - DNA, 19 bp, Homo sapiens
cccagtgtttagactatct

SEQ ID NO: 45875 - DNA, 18 bp, Homo sapiens
cccagtgtttagactatc

SEQ ID NO: 45876 - DNA, 17 bp, Homo sapiens
cccagtgtttagactat

SEQ ID NO: 45877 - DNA, 24 bp, Homo sapiens
cagaaggggagttgggagcagaga

SEQ ID NO: 45878 - DNA, 23 bp, Homo sapiens
cagaaggggagttgggagcagag

SEQ ID NO: 45879 - DNA, 21 bp, Homo sapiens
cagaaggggagttgggagcag

SEQ ID NO: 45880 - DNA, 20 bp, Homo sapiens
cagaaggggagttgggagca

SEQ ID NO: 45881 - DNA, 19 bp, Homo sapiens
cagaaggggagttgggagc

SEQ ID NO: 45882 - DNA, 24 bp, Homo sapiens
agaattgtggctggacatctgtgg

SEQ ID NO: 45883 - DNA, 21 bp, Homo sapiens
agaattgtggctggacatctg

SEQ ID NO: 45884 - DNA, 22 bp, Homo sapiens
gagaattgtggctggacatctg

SEQ ID NO: 45885 - DNA, 16 bp, Homo sapiens
agatgtccagccacaa

SEQ ID NO: 45886 - DNA, 17 bp, Homo sapiens
agatgtccagccacaat

SEQ ID NO: 45887 - DNA, 18 bp, Homo sapiens
agatgtccagccacaatt

SEQ ID NO: 45888 - DNA, 19 bp, Homo sapiens
agatgtccagccacaattc

SEQ ID NO: 45889 - DNA, 20 bp, Homo sapiens
agaattgtggctggacatct

SEQ ID NO: 45890 - DNA, 20 bp, Homo sapiens
agatgtccagccacaattct

SEQ ID NO: 45891 - DNA, 21 bp, Homo sapiens
gagaattgtggctggacatct

SEQ ID NO: 45892 - DNA, 21 bp, Homo sapiens
agatgtccagccacaattctc

SEQ ID NO: 45893 - DNA, 22 bp, Homo sapiens
cgagaattgtggctggacatct

SEQ ID NO: 45894 - DNA, 23 bp, Homo sapiens
agatgtccagccacaattctcgg

SEQ ID NO: 45895 - DNA, 24 bp, Homo sapiens
agatgtccagccacaattctcggt

SEQ ID NO: 45896 - DNA, 19 bp, Homo sapiens
agaattgtggctggacatc

SEQ ID NO: 45897 - DNA, 21 bp, Homo sapiens
gatgtccagccacaattctcg

SEQ ID NO: 45898 - DNA, 22 bp, Homo sapiens
gatgtccagccacaattctcgg

SEQ ID NO: 45899 - DNA, 18 bp, Homo sapiens
aaacgcaattcttgtacg

SEQ ID NO: 45900 - DNA, 21 bp, Homo sapiens
cgtacaagaattgcgtttgga

SEQ ID NO: 45901 - DNA, 25 bp, Homo sapiens
gtacaagaattgcgtttggacaatc

SEQ ID NO: 45902 - DNA, 21 bp, Homo sapiens
tacaagaattgcgtttggaca

SEQ ID NO: 45903 - DNA, 22 bp, Homo sapiens
tacaagaattgcgtttggacaa

SEQ ID NO: 45904 - DNA, 24 bp, Homo sapiens
tacaagaattgcgtttggacaatc

SEQ ID NO: 45905 - DNA, 24 bp, Homo sapiens
tgattgtccaaacgcaattcttgt

SEQ ID NO: 45906 - DNA, 23 bp, Homo sapiens
tgattgtccaaacgcaattcttg

SEQ ID NO: 45907 - DNA, 20 bp, Homo sapiens
aagaattgcgtttggacaat

SEQ ID NO: 45908 - DNA, 21 bp, Homo sapiens
aagaattgcgtttggacaatc

SEQ ID NO: 45909 - DNA, 22 bp, Homo sapiens
tgattgtccaaacgcaattctt

SEQ ID NO: 45910 - DNA, 22 bp, Homo sapiens
aagaattgcgtttggacaatca

SEQ ID NO: 45911 - DNA, 23 bp, Homo sapiens
aagaattgcgtttggacaatcag

SEQ ID NO: 45912 - DNA, 24 bp, Homo sapiens
aagaattgcgtttggacaatcagt

SEQ ID NO: 45913 - DNA, 21 bp, Homo sapiens
aattgcgtttggacaatcagt

SEQ ID NO: 45914 - DNA, 24 bp, Homo sapiens
gcttggggtttggggtgcagacat

SEQ ID NO: 45915 - DNA, 23 bp, Homo sapiens
cttggggtttggggtgcagacat

SEQ ID NO: 45916 - DNA, 24 bp, Homo sapiens
cttggggtttggggtgcagacatt

SEQ ID NO: 45917 - DNA, 21 bp, Homo sapiens
ttggggtttggggtgcagaca

SEQ ID NO: 45918 - DNA, 22 bp, Homo sapiens
ttggggtttggggtgcagacat

SEQ ID NO: 45919 - DNA, 23 bp, Homo sapiens
ttggggtttggggtgcagacatt

SEQ ID NO: 45920 - DNA, 24 bp, Homo sapiens
ttggggtttggggtgcagacattg

SEQ ID NO: 45921 - DNA, 26 bp, Homo sapiens
ttggggtttggggtgcagacattgcc

SEQ ID NO: 45922 - DNA, 23 bp, Homo sapiens
tggggtttggggtgcagacattg

SEQ ID NO: 45923 - DNA, 24 bp, Homo sapiens
tggggtttggggtgcagacattgc

SEQ ID NO: 45924 - DNA, 25 bp, Homo sapiens
gcagactgaccttcaaccccacagg

SEQ ID NO: 45925 - DNA, 22 bp, Homo sapiens
cagactgaccttcaaccccaca

SEQ ID NO: 45926 - DNA, 23 bp, Homo sapiens
cagactgaccttcaaccccacag

SEQ ID NO: 45927 - DNA, 24 bp, Homo sapiens
cagactgaccttcaaccccacagg

SEQ ID NO: 45928 - DNA, 17 bp, Homo sapiens
agactgaccttcaaccc

SEQ ID NO: 45929 - DNA, 19 bp, Homo sapiens
agactgaccttcaacccca

SEQ ID NO: 45930 - DNA, 20 bp, Homo sapiens
agactgaccttcaaccccac

SEQ ID NO: 45931 - DNA, 21 bp, Homo sapiens
agactgaccttcaaccccaca

SEQ ID NO: 45932 - DNA, 23 bp, Homo sapiens
agactgaccttcaaccccacagg

SEQ ID NO: 45933 - DNA, 24 bp, Homo sapiens
agactgaccttcaaccccacaggt

SEQ ID NO: 45934 - DNA, 25 bp, Homo sapiens
agactgaccttcaaccccacaggta

SEQ ID NO: 45935 - DNA, 21 bp, Homo sapiens
aagagaggagcagtggtgctg

SEQ ID NO: 45936 - DNA, 22 bp, Homo sapiens
aagagaggagcagtggtgctgt

SEQ ID NO: 45937 - DNA, 25 bp, Homo sapiens
aagagaggagcagtggtgctgtggc

SEQ ID NO: 45938 - DNA, 20 bp, Homo sapiens
agagaggagcagtggtgctg

SEQ ID NO: 45939 - DNA, 23 bp, Homo sapiens
agagaggagcagtggtgctgtgg

SEQ ID NO: 45940 - DNA, 24 bp, Homo sapiens
agagaggagcagtggtgctgtggc

SEQ ID NO: 45941 - DNA, 22 bp, Homo sapiens
gagaggagcagtggtgctgtgg

SEQ ID NO: 45942 - DNA, 26 bp, Homo sapiens
tcgctacagccctgtgatctttccag

SEQ ID NO: 45943 - DNA, 23 bp, Homo sapiens
tacagccctgtgatctttccagg

SEQ ID NO: 45944 - DNA, 21 bp, Homo sapiens
acagccctgtgatctttccag

SEQ ID NO: 45945 - DNA, 22 bp, Homo sapiens
acagccctgtgatctttccagg

SEQ ID NO: 45946 - DNA, 20 bp, Homo sapiens
aggtcggtgcaaaagtcatc

SEQ ID NO: 45947 - DNA, 23 bp, Homo sapiens
aggtcggtgcaaaagtcatcacg

SEQ ID NO: 45948 - DNA, 22 bp, Homo sapiens
ggtcggtgcaaaagtcatcacg

SEQ ID NO: 45949 - DNA, 19 bp, Homo sapiens
gtcggtgcaaaagtcatca

SEQ ID NO: 45950 - DNA, 21 bp, Homo sapiens
gtcggtgcaaaagtcatcacg

SEQ ID NO: 45951 - DNA, 22 bp, Homo sapiens
gtcggtgcaaaagtcatcacgg

SEQ ID NO: 45952 - DNA, 23 bp, Homo sapiens
gtcggtgcaaaagtcatcacggt

SEQ ID NO: 45953 - DNA, 24 bp, Homo sapiens
gtcggtgcaaaagtcatcacggtt

SEQ ID NO: 45954 - DNA, 25 bp, Homo sapiens
gtcggtgcaaaagtcatcacggttt

SEQ ID NO: 45955 - DNA, 22 bp, Homo sapiens
tcggtgcaaaagtcatcacggt

SEQ ID NO: 45956 - DNA, 23 bp, Homo sapiens
tcggtgcaaaagtcatcacggtt

SEQ ID NO: 45957 - DNA, 21 bp, Homo sapiens
cggtgcaaaagtcatcacggt

SEQ ID NO: 45958 - DNA, 22 bp, Homo sapiens
cggtgcaaaagtcatcacggtt

SEQ ID NO: 45959 - DNA, 23 bp, Homo sapiens
cggtgcaaaagtcatcacggttt

SEQ ID NO: 45960 - DNA, 20 bp, Homo sapiens
ggtgcaaaagtcatcacggt

SEQ ID NO: 45961 - DNA, 21 bp, Homo sapiens
ggtgcaaaagtcatcacggtt

SEQ ID NO: 45962 - DNA, 21 bp, Homo sapiens
gtgcaaaagtcatcacggttt

SEQ ID NO: 45963 - DNA, 22 bp, Homo sapiens
gtgcaaaagtcatcacggtttt

SEQ ID NO: 45964 - DNA, 19 bp, Homo sapiens
tgcaaaagtcatcacggtt

SEQ ID NO: 45965 - DNA, 21 bp, Homo sapiens
aaagtcatcacggtttttacc

SEQ ID NO: 45966 - DNA, 23 bp, Homo sapiens
ttcagggccgaagggtggaagct

SEQ ID NO: 45967 - DNA, 20 bp, Homo sapiens
tcagggccgaagggtggaag

SEQ ID NO: 45968 - DNA, 21 bp, Homo sapiens
tcagggccgaagggtggaagc

SEQ ID NO: 45969 - DNA, 22 bp, Homo sapiens
tcagggccgaagggtggaagct

SEQ ID NO: 45970 - DNA, 23 bp, Homo sapiens
tcagggccgaagggtggaagctg

SEQ ID NO: 45971 - DNA, 24 bp, Homo sapiens
tcagggccgaagggtggaagctgc

SEQ ID NO: 45972 - DNA, 19 bp, Homo sapiens
cagggccgaagggtggaag

SEQ ID NO: 45973 - DNA, 20 bp, Homo sapiens
cagggccgaagggtggaagc

SEQ ID NO: 45974 - DNA, 21 bp, Homo sapiens
cagggccgaagggtggaagct

SEQ ID NO: 45975 - DNA, 22 bp, Homo sapiens
cagggccgaagggtggaagctg

SEQ ID NO: 45976 - DNA, 23 bp, Homo sapiens
cagggccgaagggtggaagctgc

SEQ ID NO: 45977 - DNA, 18 bp, Homo sapiens
agggccgaagggtggaag

SEQ ID NO: 45978 - DNA, 20 bp, Homo sapiens
agggccgaagggtggaagct

SEQ ID NO: 45979 - DNA, 21 bp, Homo sapiens
agggccgaagggtggaagctg

SEQ ID NO: 45980 - DNA, 23 bp, Homo sapiens
agggccgaagggtggaagctgct

SEQ ID NO: 45981 - DNA, 25 bp, Homo sapiens
agggccgaagggtggaagctgctgg

SEQ ID NO: 45982 - DNA, 27 bp, Homo sapiens
agggccgaagggtggaagctgctggtg

SEQ ID NO: 45983 - DNA, 22 bp, Homo sapiens
cagcctctgcccttggcctccc

SEQ ID NO: 45984 - DNA, 21 bp, Homo sapiens
agcctctgcccttggcctccc

SEQ ID NO: 45985 - DNA, 23 bp, Homo sapiens
agcctctgcccttggcctcccca

SEQ ID NO: 45986 - DNA, 22 bp, Homo sapiens
cctctgcccttggcctccccag

SEQ ID NO: 45987 - DNA, 23 bp, Homo sapiens
cctctgcccttggcctccccagc

SEQ ID NO: 45988 - DNA, 24 bp, Homo sapiens
cctctgcccttggcctccccagct

SEQ ID NO: 45989 - DNA, 22 bp, Homo sapiens
ctctgcccttggcctccccagc

SEQ ID NO: 45990 - DNA, 18 bp, Homo sapiens
tgtgtccgggaagtggag

SEQ ID NO: 45991 - DNA, 20 bp, Homo sapiens
tgtgtccgggaagtggagga

SEQ ID NO: 45992 - DNA, 21 bp, Homo sapiens
tgtgtccgggaagtggaggag

SEQ ID NO: 45993 - DNA, 26 bp, Homo sapiens
tgtgtccgggaagtggaggagggccc

SEQ ID NO: 45994 - DNA, 23 bp, Homo sapiens
tgtgatatcgtgcttcctgggac

SEQ ID NO: 45995 - DNA, 21 bp, Homo sapiens
gtgatatcgtgcttcctggga

SEQ ID NO: 45996 - DNA, 21 bp, Homo sapiens
tgtgatatcgtgcttcctggg

SEQ ID NO: 45997 - DNA, 20 bp, Homo sapiens
tgtgatatcgtgcttcctgg

SEQ ID NO: 45998 - DNA, 23 bp, Homo sapiens
aggcaggagccggactggacctc

SEQ ID NO: 45999 - DNA, 24 bp, Homo sapiens
tccaggcaggagccggactggacc

SEQ ID NO: 46000 - DNA, 23 bp, Homo sapiens
tccaggcaggagccggactggac

SEQ ID NO: 46001 - DNA, 21 bp, Homo sapiens
tccaggcaggagccggactgg

SEQ ID NO: 46002 - DNA, 20 bp, Homo sapiens
tccaggcaggagccggactg

SEQ ID NO: 46003 - DNA, 26 bp, Homo sapiens
ctgggctcgggacgcgcggctcagct

SEQ ID NO: 46004 - DNA, 20 bp, Homo sapiens
gctcgggacgcgcggctcag

SEQ ID NO: 46005 - DNA, 24 bp, Homo sapiens
ctgggctcgggacgcgcggctcag

SEQ ID NO: 46006 - DNA, 23 bp, Homo sapiens
ctgggctcgggacgcgcggctca

SEQ ID NO: 46007 - DNA, 22 bp, Homo sapiens
ctgggctcgggacgcgcggctc

SEQ ID NO: 46008 - DNA, 20 bp, Homo sapiens
ctgggctcgggacgcgcggc

SEQ ID NO: 46009 - DNA, 19 bp, Homo sapiens
ctgggctcgggacgcgcgg

SEQ ID NO: 46010 - DNA, 18 bp, Homo sapiens
cattattacttttggtac

SEQ ID NO: 46011 - DNA, 19 bp, Homo sapiens
cattattacttttggtacg

SEQ ID NO: 46012 - DNA, 20 bp, Homo sapiens
cattattacttttggtacgc

SEQ ID NO: 46013 - DNA, 22 bp, Homo sapiens
cattattacttttggtacgcgc

SEQ ID NO: 46014 - DNA, 23 bp, Homo sapiens
cattattacttttggtacgcgct

SEQ ID NO: 46015 - DNA, 22 bp, Homo sapiens
ctcgtaccgtgagtaataatgc

SEQ ID NO: 46016 - DNA, 17 bp, Homo sapiens
tcgtaccgtgagtaata

SEQ ID NO: 46017 - DNA, 18 bp, Homo sapiens
tcgtaccgtgagtaataa

SEQ ID NO: 46018 - DNA, 19 bp, Homo sapiens
tcgtaccgtgagtaataat

SEQ ID NO: 46019 - DNA, 20 bp, Homo sapiens
tcgtaccgtgagtaataatg

SEQ ID NO: 46020 - DNA, 21 bp, Homo sapiens
tcgtaccgtgagtaataatgc

SEQ ID NO: 46021 - DNA, 23 bp, Homo sapiens
tcgtaccgtgagtaataatgcgc

SEQ ID NO: 46022 - DNA, 24 bp, Homo sapiens
tcgtaccgtgagtaataatgcgcc

SEQ ID NO: 46023 - DNA, 18 bp, Homo sapiens
cgtaccgtgagtaataat

SEQ ID NO: 46024 - DNA, 20 bp, Homo sapiens
cgtaccgtgagtaataatgc

SEQ ID NO: 46025 - DNA, 21 bp, Homo sapiens
cgtaccgtgagtaataatgcg

SEQ ID NO: 46026 - DNA, 22 bp, Homo sapiens
cgtaccgtgagtaataatgcgc

SEQ ID NO: 46027 - DNA, 23 bp, Homo sapiens
aggcgcacccgaccacatgcatg

SEQ ID NO: 46028 - DNA, 21 bp, Homo sapiens
aggcgcacccgaccacatgca

SEQ ID NO: 46029 - DNA, 19 bp, Homo sapiens
ggtgcccctgggccggcct

SEQ ID NO: 46030 - DNA, 20 bp, Homo sapiens
ggaacgcgcgcggccgtgct

SEQ ID NO: 46031 - DNA, 16 bp, Homo sapiens
cgcgcggccgtgctcg

SEQ ID NO: 46032 - DNA, 18 bp, Homo sapiens
cgcgcggccgtgctcgga

SEQ ID NO: 46033 - DNA, 19 bp, Homo sapiens
cgcgcggccgtgctcggag

SEQ ID NO: 46034 - DNA, 20 bp, Homo sapiens
cgcgcggccgtgctcggagc

SEQ ID NO: 46035 - DNA, 21 bp, Homo sapiens
cgcgcggccgtgctcggagca

SEQ ID NO: 46036 - DNA, 23 bp, Homo sapiens
cgcgcggccgtgctcggagcagc

SEQ ID NO: 46037 - DNA, 24 bp, Homo sapiens
cgcgcggccgtgctcggagcagcg

SEQ ID NO: 46038 - DNA, 19 bp, Homo sapiens
cggccgtgctcggagcagc

SEQ ID NO: 46039 - DNA, 18 bp, Homo sapiens
gccgtgctcggagcagcg

SEQ ID NO: 46040 - DNA, 18 bp, Homo sapiens
ggggtctgcagggcggtg

SEQ ID NO: 46041 - DNA, 22 bp, Homo sapiens
cgggtcggggtctgcagggcgg

SEQ ID NO: 46042 - DNA, 17 bp, Homo sapiens
tggggacgcgggtcggg

SEQ ID NO: 46043 - DNA, 25 bp, Homo sapiens
tgacccacccctctccaccagcttc

SEQ ID NO: 46044 - DNA, 24 bp, Homo sapiens
tgacccacccctctccaccagctt

SEQ ID NO: 46045 - DNA, 23 bp, Homo sapiens
tgacccacccctctccaccagct

SEQ ID NO: 46046 - DNA, 28 bp, Homo sapiens
ctgggtgacccacccctctccaccagct

SEQ ID NO: 46047 - DNA, 21 bp, Homo sapiens
gacccacccctctccaccagc

SEQ ID NO: 46048 - DNA, 22 bp, Homo sapiens
tgacccacccctctccaccagc

SEQ ID NO: 46049 - DNA, 23 bp, Homo sapiens
gtgacccacccctctccaccagc

SEQ ID NO: 46050 - DNA, 22 bp, Homo sapiens
gtgacccacccctctccaccag

SEQ ID NO: 46051 - DNA, 21 bp, Homo sapiens
gtgacccacccctctccacca

SEQ ID NO: 46052 - DNA, 25 bp, Homo sapiens
tgtggagtggggtgcctgtcccctg

SEQ ID NO: 46053 - DNA, 27 bp, Homo sapiens
tctgtggagtggggtgcctgtcccctg

SEQ ID NO: 46054 - DNA, 24 bp, Homo sapiens
tgtggagtggggtgcctgtcccct

SEQ ID NO: 46055 - DNA, 23 bp, Homo sapiens
tgtggagtggggtgcctgtcccc

SEQ ID NO: 46056 - DNA, 22 bp, Homo sapiens
tgtggagtggggtgcctgtccc

SEQ ID NO: 46057 - DNA, 21 bp, Homo sapiens
tgtggagtggggtgcctgtcc

SEQ ID NO: 46058 - DNA, 20 bp, Homo sapiens
tgtggagtggggtgcctgtc

SEQ ID NO: 46059 - DNA, 19 bp, Homo sapiens
tgtggagtggggtgcctgt

SEQ ID NO: 46060 - DNA, 19 bp, Homo sapiens
tctgtggagtggggtgcct

SEQ ID NO: 46061 - DNA, 21 bp, Homo sapiens
tgacacgggcgacagctgcgg

SEQ ID NO: 46062 - DNA, 24 bp, Homo sapiens
tgacacgggcgacagctgcggccc

SEQ ID NO: 46063 - DNA, 17 bp, Homo sapiens
gacacgggcgacagctg

SEQ ID NO: 46064 - DNA, 18 bp, Homo sapiens
gacacgggcgacagctgc

SEQ ID NO: 46065 - DNA, 19 bp, Homo sapiens
gacacgggcgacagctgcg

SEQ ID NO: 46066 - DNA, 20 bp, Homo sapiens
gacacgggcgacagctgcgg

SEQ ID NO: 46067 - DNA, 24 bp, Homo sapiens
gacacgggcgacagctgcggcccg

SEQ ID NO: 46068 - DNA, 25 bp, Homo sapiens
gacacgggcgacagctgcggcccgc

SEQ ID NO: 46069 - DNA, 26 bp, Homo sapiens
gacacgggcgacagctgcggcccgct

SEQ ID NO: 46070 - DNA, 20 bp, Homo sapiens
acacgggcgacagctgcggc

SEQ ID NO: 46071 - DNA, 21 bp, Homo sapiens
acacgggcgacagctgcggcc

SEQ ID NO: 46072 - DNA, 16 bp, Homo sapiens
agagttattgcctctg

SEQ ID NO: 46073 - DNA, 22 bp, Homo sapiens
ttattgcctctgttctaacaca

SEQ ID NO: 46074 - DNA, 23 bp, Homo sapiens
ttattgcctctgttctaacacaa

SEQ ID NO: 46075 - DNA, 19 bp, Homo sapiens
attgcctctgttctaacac

SEQ ID NO: 46076 - DNA, 20 bp, Homo sapiens
attgcctctgttctaacaca

SEQ ID NO: 46077 - DNA, 21 bp, Homo sapiens
attgcctctgttctaacacaa

SEQ ID NO: 46078 - DNA, 23 bp, Homo sapiens
attgcctctgttctaacacaaga

SEQ ID NO: 46079 - DNA, 22 bp, Homo sapiens
ttgcctctgttctaacacaaga

SEQ ID NO: 46080 - DNA, 21 bp, Homo sapiens
ctgtgttagaataggggcaat

SEQ ID NO: 46081 - DNA, 22 bp, Homo sapiens
ctgtgttagaataggggcaata

SEQ ID NO: 46082 - DNA, 17 bp, Homo sapiens
tgtgttagaataggggc

SEQ ID NO: 46083 - DNA, 23 bp, Homo sapiens
tgtgttagaataggggcaataac

SEQ ID NO: 46084 - DNA, 21 bp, Homo sapiens
gtgttagaataggggcaataa

SEQ ID NO: 46085 - DNA, 22 bp, Homo sapiens
tgttagaataggggcaataact

SEQ ID NO: 46086 - DNA, 19 bp, Homo sapiens
gttagaataggggcaataa

SEQ ID NO: 46087 - DNA, 23 bp, Homo sapiens
tgctctccgttacaagtatcccc

SEQ ID NO: 46088 - DNA, 20 bp, Homo sapiens
tgctctccgttacaagtatc

SEQ ID NO: 46089 - DNA, 22 bp, Homo sapiens
agtgctctccgttacaagtatc

SEQ ID NO: 46090 - DNA, 23 bp, Homo sapiens
tagtgctctccgttacaagtatc

SEQ ID NO: 46091 - DNA, 21 bp, Homo sapiens
agtgctctccgttacaagtat

SEQ ID NO: 46092 - DNA, 22 bp, Homo sapiens
tagtgctctccgttacaagtat

SEQ ID NO: 46093 - DNA, 23 bp, Homo sapiens
ctagtgctctccgttacaagtat

SEQ ID NO: 46094 - DNA, 18 bp, Homo sapiens
tgctctccgttacaagta

SEQ ID NO: 46095 - DNA, 21 bp, Homo sapiens
tagtgctctccgttacaagta

SEQ ID NO: 46096 - DNA, 20 bp, Homo sapiens
tagtgctctccgttacaagt

SEQ ID NO: 46097 - DNA, 21 bp, Homo sapiens
ctagtgctctccgttacaagt

SEQ ID NO: 46098 - DNA, 20 bp, Homo sapiens
ctagtgctctccgttacaag

SEQ ID NO: 46099 - DNA, 17 bp, Homo sapiens
ctagtgctctccgttac

SEQ ID NO: 46100 - DNA, 23 bp, Homo sapiens
tgtggctggtcatgaggctaaca

SEQ ID NO: 46101 - DNA, 22 bp, Homo sapiens
tgtggctggtcatgaggctaac

SEQ ID NO: 46102 - DNA, 23 bp, Homo sapiens
ttgtggctggtcatgaggctaac

SEQ ID NO: 46103 - DNA, 21 bp, Homo sapiens
tgtggctggtcatgaggctaa

SEQ ID NO: 46104 - DNA, 21 bp, Homo sapiens
ttgtggctggtcatgaggcta

SEQ ID NO: 46105 - DNA, 20 bp, Homo sapiens
ttgtggctggtcatgaggct

SEQ ID NO: 46106 - DNA, 19 bp, Homo sapiens
ttgtggctggtcatgaggc

SEQ ID NO: 46107 - DNA, 18 bp, Homo sapiens
ttgtggctggtcatgagg

SEQ ID NO: 46108 - DNA, 23 bp, Homo sapiens
agtctcatgatcagacacaaata

SEQ ID NO: 46109 - DNA, 22 bp, Homo sapiens
agtctcatgatcagacacaaat

SEQ ID NO: 46110 - DNA, 23 bp, Homo sapiens
ttagtctcatgatcagacacaaa

SEQ ID NO: 46111 - DNA, 21 bp, Homo sapiens
tagtctcatgatcagacacaa

SEQ ID NO: 46112 - DNA, 22 bp, Homo sapiens
ttagtctcatgatcagacacaa

SEQ ID NO: 46113 - DNA, 19 bp, Homo sapiens
agtctcatgatcagacaca

SEQ ID NO: 46114 - DNA, 22 bp, Homo sapiens
tgttagtctcatgatcagacac

SEQ ID NO: 46115 - DNA, 19 bp, Homo sapiens
ttagtctcatgatcagaca

SEQ ID NO: 46116 - DNA, 22 bp, Homo sapiens
ttgttagtctcatgatcagaca

SEQ ID NO: 46117 - DNA, 19 bp, Homo sapiens
tgttagtctcatgatcaga

SEQ ID NO: 46118 - DNA, 19 bp, Homo sapiens
agtggggaacccttccatg

SEQ ID NO: 46119 - DNA, 20 bp, Homo sapiens
agtggggaacccttccatga

SEQ ID NO: 46120 - DNA, 21 bp, Homo sapiens
agtggggaacccttccatgag

SEQ ID NO: 46121 - DNA, 23 bp, Homo sapiens
agtggggaacccttccatgagga

SEQ ID NO: 46122 - DNA, 24 bp, Homo sapiens
agtggggaacccttccatgaggag

SEQ ID NO: 46123 - DNA, 25 bp, Homo sapiens
agtggggaacccttccatgaggagt

SEQ ID NO: 46124 - DNA, 23 bp, Homo sapiens
gtggggaacccttccatgaggag

SEQ ID NO: 46125 - DNA, 22 bp, Homo sapiens
tggggaacccttccatgaggag

SEQ ID NO: 46126 - DNA, 23 bp, Homo sapiens
tggggaacccttccatgaggagt

SEQ ID NO: 46127 - DNA, 24 bp, Homo sapiens
tggggaacccttccatgaggagta

SEQ ID NO: 46128 - DNA, 22 bp, Homo sapiens
tccttatgcaagattcccttct

SEQ ID NO: 46129 - DNA, 25 bp, Homo sapiens
tccttatgcaagattcccttctacc

SEQ ID NO: 46130 - DNA, 19 bp, Homo sapiens
cttatgcaagattcccttc

SEQ ID NO: 46131 - DNA, 20 bp, Homo sapiens
cttatgcaagattcccttct

SEQ ID NO: 46132 - DNA, 21 bp, Homo sapiens
cttatgcaagattcccttcta

SEQ ID NO: 46133 - DNA, 23 bp, Homo sapiens
cttatgcaagattcccttctacc

SEQ ID NO: 46134 - DNA, 24 bp, Homo sapiens
cttatgcaagattcccttctacct

SEQ ID NO: 46135 - DNA, 20 bp, Homo sapiens
ttatgcaagattcccttcta

SEQ ID NO: 46136 - DNA, 21 bp, Homo sapiens
ttatgcaagattcccttctac

SEQ ID NO: 46137 - DNA, 22 bp, Homo sapiens
ttatgcaagattcccttctacc

SEQ ID NO: 46138 - DNA, 23 bp, Homo sapiens
ttatgcaagattcccttctacct

SEQ ID NO: 46139 - DNA, 24 bp, Homo sapiens
tatgccaacatattgccatctttc

SEQ ID NO: 46140 - DNA, 27 bp, Homo sapiens
tgctatgccaacatattgccatctttc

SEQ ID NO: 46141 - DNA, 26 bp, Homo sapiens
tgctatgccaacatattgccatcttt

SEQ ID NO: 46142 - DNA, 25 bp, Homo sapiens
tgctatgccaacatattgccatctt

SEQ ID NO: 46143 - DNA, 21 bp, Homo sapiens
tatgccaacatattgccatct

SEQ ID NO: 46144 - DNA, 24 bp, Homo sapiens
tgctatgccaacatattgccatct

SEQ ID NO: 46145 - DNA, 22 bp, Homo sapiens
gctatgccaacatattgccatc

SEQ ID NO: 46146 - DNA, 23 bp, Homo sapiens
tgctatgccaacatattgccatc

SEQ ID NO: 46147 - DNA, 21 bp, Homo sapiens
tgctatgccaacatattgcca

SEQ ID NO: 46148 - DNA, 20 bp, Homo sapiens
tgctatgccaacatattgcc

SEQ ID NO: 46149 - DNA, 19 bp, Homo sapiens
tgctatgccaacatattgc

SEQ ID NO: 46150 - DNA, 18 bp, Homo sapiens
tgctatgccaacatattg

SEQ ID NO: 46151 - DNA, 17 bp, Homo sapiens
tgctatgccaacatatt

SEQ ID NO: 46152 - DNA, 25 bp, Homo sapiens
aggcaagatgctggcatagctgttg

SEQ ID NO: 46153 - DNA, 24 bp, Homo sapiens
aggcaagatgctggcatagctgtt

SEQ ID NO: 46154 - DNA, 23 bp, Homo sapiens
aggcaagatgctggcatagctgt

SEQ ID NO: 46155 - DNA, 21 bp, Homo sapiens
ggcaagatgctggcatagctg

SEQ ID NO: 46156 - DNA, 22 bp, Homo sapiens
aggcaagatgctggcatagctg

SEQ ID NO: 46157 - DNA, 20 bp, Homo sapiens
aggcaagatgctggcatagc

SEQ ID NO: 46158 - DNA, 19 bp, Homo sapiens
aggcaagatgctggcatag

SEQ ID NO: 46159 - DNA, 27 bp, Homo sapiens
tggtggtttacaaagtaattcatagtg

SEQ ID NO: 46160 - DNA, 25 bp, Homo sapiens
tggtggtttacaaagtaattcatag

SEQ ID NO: 46161 - DNA, 22 bp, Homo sapiens
gtggtttacaaagtaattcata

SEQ ID NO: 46162 - DNA, 24 bp, Homo sapiens
tggtggtttacaaagtaattcata

SEQ ID NO: 46163 - DNA, 21 bp, Homo sapiens
gtggtttacaaagtaattcat

SEQ ID NO: 46164 - DNA, 17 bp, Homo sapiens
gtttacaaagtaattca

SEQ ID NO: 46165 - DNA, 20 bp, Homo sapiens
gtggtttacaaagtaattca

SEQ ID NO: 46166 - DNA, 19 bp, Homo sapiens
gtggtttacaaagtaattc

SEQ ID NO: 46167 - DNA, 21 bp, Homo sapiens
tggtggtttacaaagtaattc

SEQ ID NO: 46168 - DNA, 20 bp, Homo sapiens
tggtggtttacaaagtaatt

SEQ ID NO: 46169 - DNA, 19 bp, Homo sapiens
tggtggtttacaaagtaat

SEQ ID NO: 46170 - DNA, 18 bp, Homo sapiens
tggtggtttacaaagtaa

SEQ ID NO: 46171 - DNA, 21 bp, Homo sapiens
tgtggtggtggtttacaaagt

SEQ ID NO: 46172 - DNA, 26 bp, Homo sapiens
ggatttctttgtgaatcaccatatct

SEQ ID NO: 46173 - DNA, 26 bp, Homo sapiens
tggatttctttgtgaatcaccatatc

SEQ ID NO: 46174 - DNA, 22 bp, Homo sapiens
gatttctttgtgaatcaccata

SEQ ID NO: 46175 - DNA, 24 bp, Homo sapiens
tggatttctttgtgaatcaccata

SEQ ID NO: 46176 - DNA, 18 bp, Homo sapiens
ttctttgtgaatcaccat

SEQ ID NO: 46177 - DNA, 21 bp, Homo sapiens
gatttctttgtgaatcaccat

SEQ ID NO: 46178 - DNA, 23 bp, Homo sapiens
tggatttctttgtgaatcaccat

SEQ ID NO: 46179 - DNA, 19 bp, Homo sapiens
gatttctttgtgaatcacc

SEQ ID NO: 46180 - DNA, 20 bp, Homo sapiens
ggatttctttgtgaatcacc

SEQ ID NO: 46181 - DNA, 21 bp, Homo sapiens
tggatttctttgtgaatcacc

SEQ ID NO: 46182 - DNA, 20 bp, Homo sapiens
tggatttctttgtgaatcac

SEQ ID NO: 46183 - DNA, 19 bp, Homo sapiens
tggatttctttgtgaatca

SEQ ID NO: 46184 - DNA, 23 bp, Homo sapiens
gagactgatgagttcccgggaac

SEQ ID NO: 46185 - DNA, 24 bp, Homo sapiens
ggagactgatgagttcccgggaac

SEQ ID NO: 46186 - DNA, 22 bp, Homo sapiens
gagactgatgagttcccgggaa

SEQ ID NO: 46187 - DNA, 23 bp, Homo sapiens
ggagactgatgagttcccgggaa

SEQ ID NO: 46188 - DNA, 25 bp, Homo sapiens
caggagactgatgagttcccgggaa

SEQ ID NO: 46189 - DNA, 21 bp, Homo sapiens
gagactgatgagttcccggga

SEQ ID NO: 46190 - DNA, 20 bp, Homo sapiens
gagactgatgagttcccggg

SEQ ID NO: 46191 - DNA, 18 bp, Homo sapiens
ggagactgatgagttccc

SEQ ID NO: 46192 - DNA, 23 bp, Homo sapiens
caggaacttgtgagtctcctatt

SEQ ID NO: 46193 - DNA, 24 bp, Homo sapiens
gcaggaacttgtgagtctcctatt

SEQ ID NO: 46194 - DNA, 25 bp, Homo sapiens
tgcaggaacttgtgagtctcctatt

SEQ ID NO: 46195 - DNA, 23 bp, Homo sapiens
gcaggaacttgtgagtctcctat

SEQ ID NO: 46196 - DNA, 22 bp, Homo sapiens
gcaggaacttgtgagtctccta

SEQ ID NO: 46197 - DNA, 23 bp, Homo sapiens
tgcaggaacttgtgagtctccta

SEQ ID NO: 46198 - DNA, 22 bp, Homo sapiens
tgcaggaacttgtgagtctcct

SEQ ID NO: 46199 - DNA, 20 bp, Homo sapiens
gcaggaacttgtgagtctcc

SEQ ID NO: 46200 - DNA, 21 bp, Homo sapiens
tgcaggaacttgtgagtctcc

SEQ ID NO: 46201 - DNA, 19 bp, Homo sapiens
gcaggaacttgtgagtctc

SEQ ID NO: 46202 - DNA, 20 bp, Homo sapiens
tgcaggaacttgtgagtctc

SEQ ID NO: 46203 - DNA, 22 bp, Homo sapiens
ctttgtacccctccagtctccg

SEQ ID NO: 46204 - DNA, 24 bp, Homo sapiens
ggccctttgtacccctccagtctc

SEQ ID NO: 46205 - DNA, 25 bp, Homo sapiens
tggccctttgtacccctccagtctc

SEQ ID NO: 46206 - DNA, 24 bp, Homo sapiens
tggccctttgtacccctccagtct

SEQ ID NO: 46207 - DNA, 21 bp, Homo sapiens
gccctttgtacccctccagtc

SEQ ID NO: 46208 - DNA, 23 bp, Homo sapiens
tggccctttgtacccctccagtc

SEQ ID NO: 46209 - DNA, 21 bp, Homo sapiens
ggccctttgtacccctccagt

SEQ ID NO: 46210 - DNA, 22 bp, Homo sapiens
tggccctttgtacccctccagt

SEQ ID NO: 46211 - DNA, 19 bp, Homo sapiens
ggccctttgtacccctcca

SEQ ID NO: 46212 - DNA, 20 bp, Homo sapiens
tggccctttgtacccctcca

SEQ ID NO: 46213 - DNA, 28 bp, Homo sapiens
aggaggtggtactaggggccagcaacct

SEQ ID NO: 46214 - DNA, 26 bp, Homo sapiens
aggaggtggtactaggggccagcaac

SEQ ID NO: 46215 - DNA, 22 bp, Homo sapiens
aggtggtactaggggccagcaa

SEQ ID NO: 46216 - DNA, 25 bp, Homo sapiens
aggaggtggtactaggggccagcaa

SEQ ID NO: 46217 - DNA, 26 bp, Homo sapiens
gaggaggtggtactaggggccagcaa

SEQ ID NO: 46218 - DNA, 24 bp, Homo sapiens
aggaggtggtactaggggccagca

SEQ ID NO: 46219 - DNA, 25 bp, Homo sapiens
gaggaggtggtactaggggccagca

SEQ ID NO: 46220 - DNA, 26 bp, Homo sapiens
ggaggaggtggtactaggggccagca

SEQ ID NO: 46221 - DNA, 21 bp, Homo sapiens
gaggtggtactaggggccagc

SEQ ID NO: 46222 - DNA, 24 bp, Homo sapiens
gaggaggtggtactaggggccagc

SEQ ID NO: 46223 - DNA, 25 bp, Homo sapiens
ggaggaggtggtactaggggccagc

SEQ ID NO: 46224 - DNA, 23 bp, Homo sapiens
gaggaggtggtactaggggccag

SEQ ID NO: 46225 - DNA, 24 bp, Homo sapiens
ggaggaggtggtactaggggccag

SEQ ID NO: 46226 - DNA, 22 bp, Homo sapiens
gaggaggtggtactaggggcca

SEQ ID NO: 46227 - DNA, 19 bp, Homo sapiens
aggaggtggtactaggggc

SEQ ID NO: 46228 - DNA, 20 bp, Homo sapiens
gaggaggtggtactaggggc

SEQ ID NO: 46229 - DNA, 21 bp, Homo sapiens
ggaggaggtggtactaggggc

SEQ ID NO: 46230 - DNA, 19 bp, Homo sapiens
gaggaggtggtactagggg

SEQ ID NO: 46231 - DNA, 23 bp, Homo sapiens
tctgactggggagcagaaggaga

SEQ ID NO: 46232 - DNA, 20 bp, Homo sapiens
tgactggggagcagaaggag

SEQ ID NO: 46233 - DNA, 21 bp, Homo sapiens
tgactggggagcagaaggaga

SEQ ID NO: 46234 - DNA, 23 bp, Homo sapiens
tgactggggagcagaaggagaac

SEQ ID NO: 46235 - DNA, 24 bp, Homo sapiens
tgactggggagcagaaggagaacc

SEQ ID NO: 46236 - DNA, 20 bp, Homo sapiens
gactggggagcagaaggaga

SEQ ID NO: 46237 - DNA, 21 bp, Homo sapiens
gactggggagcagaaggagaa

SEQ ID NO: 46238 - DNA, 22 bp, Homo sapiens
gactggggagcagaaggagaac

SEQ ID NO: 46239 - DNA, 23 bp, Homo sapiens
gactggggagcagaaggagaacc

SEQ ID NO: 46240 - DNA, 24 bp, Homo sapiens
gactggggagcagaaggagaaccc

SEQ ID NO: 46241 - DNA, 18 bp, Homo sapiens
actggggagcagaaggag

SEQ ID NO: 46242 - DNA, 19 bp, Homo sapiens
actggggagcagaaggaga

SEQ ID NO: 46243 - DNA, 20 bp, Homo sapiens
actggggagcagaaggagaa

SEQ ID NO: 46244 - DNA, 21 bp, Homo sapiens
actggggagcagaaggagaac

SEQ ID NO: 46245 - DNA, 23 bp, Homo sapiens
actggggagcagaaggagaaccc

SEQ ID NO: 46246 - DNA, 24 bp, Homo sapiens
actggggagcagaaggagaaccca

SEQ ID NO: 46247 - DNA, 25 bp, Homo sapiens
actggggagcagaaggagaacccaa

SEQ ID NO: 46248 - DNA, 26 bp, Homo sapiens
actggggagcagaaggagaacccaag

SEQ ID NO: 46249 - DNA, 27 bp, Homo sapiens
actggggagcagaaggagaacccaaga

SEQ ID NO: 46250 - DNA, 19 bp, Homo sapiens
ctggggagcagaaggagaa

SEQ ID NO: 46251 - DNA, 21 bp, Homo sapiens
ctggggagcagaaggagaacc

SEQ ID NO: 46252 - DNA, 23 bp, Homo sapiens
ctggggagcagaaggagaaccca

SEQ ID NO: 46253 - DNA, 24 bp, Homo sapiens
ctggggagcagaaggagaacccaa

SEQ ID NO: 46254 - DNA, 19 bp, Homo sapiens
tggggagcagaaggagaac

SEQ ID NO: 46255 - DNA, 22 bp, Homo sapiens
tggggagcagaaggagaaccca

SEQ ID NO: 46256 - DNA, 23 bp, Homo sapiens
tggggagcagaaggagaacccaa

SEQ ID NO: 46257 - DNA, 24 bp, Homo sapiens
tggggagcagaaggagaacccaag

SEQ ID NO: 46258 - DNA, 25 bp, Homo sapiens
tggggagcagaaggagaacccaaga

SEQ ID NO: 46259 - DNA, 23 bp, Homo sapiens
gtccctccttctgtccccacagg

SEQ ID NO: 46260 - DNA, 19 bp, Homo sapiens
tccctccttctgtccccac

SEQ ID NO: 46261 - DNA, 20 bp, Homo sapiens
tccctccttctgtccccaca

SEQ ID NO: 46262 - DNA, 22 bp, Homo sapiens
tccctccttctgtccccacagg

SEQ ID NO: 46263 - DNA, 23 bp, Homo sapiens
tccctccttctgtccccacagga

SEQ ID NO: 46264 - DNA, 24 bp, Homo sapiens
tccctccttctgtccccacaggac

SEQ ID NO: 46265 - DNA, 21 bp, Homo sapiens
ccctccttctgtccccacagg

SEQ ID NO: 46266 - DNA, 21 bp, Homo sapiens
tgtcctctgttcctcaggtgc

SEQ ID NO: 46267 - DNA, 22 bp, Homo sapiens
gatgtcctctgttcctcaggtg

SEQ ID NO: 46268 - DNA, 21 bp, Homo sapiens
gatgtcctctgttcctcaggt

SEQ ID NO: 46269 - DNA, 22 bp, Homo sapiens
tgatgtcctctgttcctcaggt

SEQ ID NO: 46270 - DNA, 22 bp, Homo sapiens
ctgatgtcctctgttcctcagg

SEQ ID NO: 46271 - DNA, 24 bp, Homo sapiens
ccctgatgtcctctgttcctcagg

SEQ ID NO: 46272 - DNA, 20 bp, Homo sapiens
tgatgtcctctgttcctcag

SEQ ID NO: 46273 - DNA, 23 bp, Homo sapiens
ccctgatgtcctctgttcctcag

SEQ ID NO: 46274 - DNA, 21 bp, Homo sapiens
cctgatgtcctctgttcctca

SEQ ID NO: 46275 - DNA, 17 bp, Homo sapiens
gatgtcctctgttcctc

SEQ ID NO: 46276 - DNA, 17 bp, Homo sapiens
ccctgatgtcctctgtt

SEQ ID NO: 46277 - DNA, 16 bp, Homo sapiens
ccctgatgtcctctgt

SEQ ID NO: 46278 - DNA, 24 bp, Homo sapiens
ccctggggttctgaggacatgctc

SEQ ID NO: 46279 - DNA, 25 bp, Homo sapiens
gccctggggttctgaggacatgctc

SEQ ID NO: 46280 - DNA, 22 bp, Homo sapiens
cctggggttctgaggacatgct

SEQ ID NO: 46281 - DNA, 23 bp, Homo sapiens
ccctggggttctgaggacatgct

SEQ ID NO: 46282 - DNA, 25 bp, Homo sapiens
tgccctggggttctgaggacatgct

SEQ ID NO: 46283 - DNA, 21 bp, Homo sapiens
cctggggttctgaggacatgc

SEQ ID NO: 46284 - DNA, 22 bp, Homo sapiens
ccctggggttctgaggacatgc

SEQ ID NO: 46285 - DNA, 23 bp, Homo sapiens
gccctggggttctgaggacatgc

SEQ ID NO: 46286 - DNA, 24 bp, Homo sapiens
tgccctggggttctgaggacatgc

SEQ ID NO: 46287 - DNA, 22 bp, Homo sapiens
gccctggggttctgaggacatg

SEQ ID NO: 46288 - DNA, 20 bp, Homo sapiens
ccctggggttctgaggacat

SEQ ID NO: 46289 - DNA, 19 bp, Homo sapiens
ccctggggttctgaggaca

SEQ ID NO: 46290 - DNA, 18 bp, Homo sapiens
ccctggggttctgaggac

SEQ ID NO: 46291 - DNA, 19 bp, Homo sapiens
gccctggggttctgaggac

SEQ ID NO: 46292 - DNA, 23 bp, Homo sapiens
aagcgtgggatgtccatgaagtc

SEQ ID NO: 46293 - DNA, 21 bp, Homo sapiens
agcgtgggatgtccatgaagt

SEQ ID NO: 46294 - DNA, 23 bp, Homo sapiens
agcgtgggatgtccatgaagtca

SEQ ID NO: 46295 - DNA, 21 bp, Homo sapiens
tgtccatgaagtcaggtgatg

SEQ ID NO: 46296 - DNA, 24 bp, Homo sapiens
ctgttcattggaaccctgcgcagg

SEQ ID NO: 46297 - DNA, 18 bp, Homo sapiens
tgttcattggaaccctgc

SEQ ID NO: 46298 - DNA, 20 bp, Homo sapiens
tgttcattggaaccctgcgc

SEQ ID NO: 46299 - DNA, 21 bp, Homo sapiens
tgttcattggaaccctgcgca

SEQ ID NO: 46300 - DNA, 23 bp, Homo sapiens
tgttcattggaaccctgcgcagg

SEQ ID NO: 46301 - DNA, 24 bp, Homo sapiens
tgttcattggaaccctgcgcaggt

SEQ ID NO: 46302 - DNA, 21 bp, Homo sapiens
caagggaccaagcattcatta

SEQ ID NO: 46303 - DNA, 20 bp, Homo sapiens
caagggaccaagcattcatt

SEQ ID NO: 46304 - DNA, 25 bp, Homo sapiens
agtcctgcctgtaggtttaccagcc

SEQ ID NO: 46305 - DNA, 21 bp, Homo sapiens
agtcctgcctgtaggtttacc

SEQ ID NO: 46306 - DNA, 24 bp, Homo sapiens
cttagtcctgcctgtaggtttacc

SEQ ID NO: 46307 - DNA, 22 bp, Homo sapiens
aaggatttagggacaggctttg

SEQ ID NO: 46308 - DNA, 22 bp, Homo sapiens
gaaggatttagggacaggcttt

SEQ ID NO: 46309 - DNA, 25 bp, Homo sapiens
caggaaggatttagggacaggcttt

SEQ ID NO: 46310 - DNA, 24 bp, Homo sapiens
caggaaggatttagggacaggctt

SEQ ID NO: 46311 - DNA, 23 bp, Homo sapiens
caggaaggatttagggacaggct

SEQ ID NO: 46312 - DNA, 21 bp, Homo sapiens
caggaaggatttagggacagg

SEQ ID NO: 46313 - DNA, 22 bp, Homo sapiens
ccaggaaggatttagggacagg

SEQ ID NO: 46314 - DNA, 20 bp, Homo sapiens
caggaaggatttagggacag

SEQ ID NO: 46315 - DNA, 21 bp, Homo sapiens
gtacagtactgtgataactga

SEQ ID NO: 46316 - DNA, 22 bp, Homo sapiens
gtacagtactgtgataactgaa

SEQ ID NO: 46317 - DNA, 24 bp, Homo sapiens
gtacagtactgtgataactgaaga

SEQ ID NO: 46318 - DNA, 23 bp, Homo sapiens
tacagtactgtgataactgaaga

SEQ ID NO: 46319 - DNA, 24 bp, Homo sapiens
tacagtactgtgataactgaagaa

SEQ ID NO: 46320 - DNA, 25 bp, Homo sapiens
tacagtactgtgataactgaagaat

SEQ ID NO: 46321 - DNA, 26 bp, Homo sapiens
tacagtactgtgataactgaagaatg

SEQ ID NO: 46322 - DNA, 27 bp, Homo sapiens
tacagtactgtgataactgaagaatgg

SEQ ID NO: 46323 - DNA, 22 bp, Homo sapiens
acagtactgtgataactgaaga

SEQ ID NO: 46324 - DNA, 18 bp, Homo sapiens
ctgggggacgcgtgagcg

SEQ ID NO: 46325 - DNA, 20 bp, Homo sapiens
ctgggggacgcgtgagcgcg

SEQ ID NO: 46326 - DNA, 21 bp, Homo sapiens
ctgggggacgcgtgagcgcga

SEQ ID NO: 46327 - DNA, 22 bp, Homo sapiens
ctgggggacgcgtgagcgcgag

SEQ ID NO: 46328 - DNA, 24 bp, Homo sapiens
ctgggggacgcgtgagcgcgagcc

SEQ ID NO: 46329 - DNA, 25 bp, Homo sapiens
ctgggggacgcgtgagcgcgagccg

SEQ ID NO: 46330 - DNA, 22 bp, Homo sapiens
tgggggacgcgtgagcgcgagc

SEQ ID NO: 46331 - DNA, 24 bp, Homo sapiens
tgggggacgcgtgagcgcgagccg

SEQ ID NO: 46332 - DNA, 20 bp, Homo sapiens
gggacgcgtgagcgcgagcc

SEQ ID NO: 46333 - DNA, 27 bp, Homo sapiens
cggctcggccgcggcgcgtagcccccg

SEQ ID NO: 46334 - DNA, 16 bp, Homo sapiens
ggccgcggcgcgtagc

SEQ ID NO: 46335 - DNA, 21 bp, Homo sapiens
ccgcggcgcgtagcccccgcc

SEQ ID NO: 46336 - DNA, 22 bp, Homo sapiens
ccgcggcgcgtagcccccgcca

SEQ ID NO: 46337 - DNA, 24 bp, Homo sapiens
ccgcggcgcgtagcccccgccaca

SEQ ID NO: 46338 - DNA, 16 bp, Homo sapiens
cgcggcgcgtagcccc

SEQ ID NO: 46339 - DNA, 20 bp, Homo sapiens
cgcggcgcgtagcccccgcc

SEQ ID NO: 46340 - DNA, 21 bp, Homo sapiens
cgcggcgcgtagcccccgcca

SEQ ID NO: 46341 - DNA, 23 bp, Homo sapiens
cgcggcgcgtagcccccgccaca

SEQ ID NO: 46342 - DNA, 25 bp, Homo sapiens
cgcggcgcgtagcccccgccacatc

SEQ ID NO: 46343 - DNA, 24 bp, Homo sapiens
ttaaggacatttgtgattcacggg

SEQ ID NO: 46344 - DNA, 23 bp, Homo sapiens
ttaaggacatttgtgattcacgg

SEQ ID NO: 46345 - DNA, 20 bp, Homo sapiens
aaggacatttgtgattcacg

SEQ ID NO: 46346 - DNA, 22 bp, Homo sapiens
ttaaggacatttgtgattcacg

SEQ ID NO: 46347 - DNA, 22 bp, Homo sapiens
ccattaaggacatttgtgattg

SEQ ID NO: 46348 - DNA, 23 bp, Homo sapiens
ccattaaggacatttgtgattga

SEQ ID NO: 46349 - DNA, 21 bp, Homo sapiens
cattaaggacatttgtgattg

SEQ ID NO: 46350 - DNA, 22 bp, Homo sapiens
cattaaggacatttgtgattga

SEQ ID NO: 46351 - DNA, 23 bp, Homo sapiens
cattaaggacatttgtgattgat

SEQ ID NO: 46352 - DNA, 24 bp, Homo sapiens
cattaaggacatttgtgattgatg

SEQ ID NO: 46353 - DNA, 21 bp, Homo sapiens
attaaggacatttgtgattga

SEQ ID NO: 46354 - DNA, 22 bp, Homo sapiens
ttaaggacatttgtgattgatg

SEQ ID NO: 46355 - DNA, 23 bp, Homo sapiens
ttaaggacatttgtgattgatgg

SEQ ID NO: 46356 - DNA, 22 bp, Homo sapiens
aaggacatttgtgattgatggg

SEQ ID NO: 46357 - DNA, 27 bp, Homo sapiens
tctggaattctgtgtgagggacaaaca

SEQ ID NO: 46358 - DNA, 27 bp, Homo sapiens
ttctggaattctgtgtgagggacaaac

SEQ ID NO: 46359 - DNA, 27 bp, Homo sapiens
gctgggaaggcaaagggacgttcaatt

SEQ ID NO: 46360 - DNA, 26 bp, Homo sapiens
gctgggaaggcaaagggacgttcaat

SEQ ID NO: 46361 - DNA, 25 bp, Homo sapiens
gctgggaaggcaaagggacgttcaa

SEQ ID NO: 46362 - DNA, 23 bp, Homo sapiens
gctgggaaggcaaagggacgttc

SEQ ID NO: 46363 - DNA, 24 bp, Homo sapiens
ggctgggaaggcaaagggacgttc

SEQ ID NO: 46364 - DNA, 22 bp, Homo sapiens
gctgggaaggcaaagggacgtt

SEQ ID NO: 46365 - DNA, 22 bp, Homo sapiens
ggctgggaaggcaaagggacgt

SEQ ID NO: 46366 - DNA, 20 bp, Homo sapiens
gctgggaaggcaaagggacg

SEQ ID NO: 46367 - DNA, 19 bp, Homo sapiens
gctgggaaggcaaagggac

SEQ ID NO: 46368 - DNA, 20 bp, Homo sapiens
ggctgggaaggcaaagggac

SEQ ID NO: 46369 - DNA, 25 bp, Homo sapiens
ttccctttgtcatcctatgcctgag

SEQ ID NO: 46370 - DNA, 24 bp, Homo sapiens
ttccctttgtcatcctatgcctga

SEQ ID NO: 46371 - DNA, 23 bp, Homo sapiens
ttccctttgtcatcctatgcctg

SEQ ID NO: 46372 - DNA, 21 bp, Homo sapiens
tccctttgtcatcctatgcct

SEQ ID NO: 46373 - DNA, 21 bp, Homo sapiens
ttccctttgtcatcctatgcc

SEQ ID NO: 46374 - DNA, 20 bp, Homo sapiens
ttccctttgtcatcctatgc

SEQ ID NO: 46375 - DNA, 17 bp, Homo sapiens
ttccctttgtcatccta

SEQ ID NO: 46376 - DNA, 23 bp, Homo sapiens
aacaaatcacagtctgccatatg

SEQ ID NO: 46377 - DNA, 24 bp, Homo sapiens
caacaaatcacagtctgccatatg

SEQ ID NO: 46378 - DNA, 22 bp, Homo sapiens
aacaaatcacagtctgccatat

SEQ ID NO: 46379 - DNA, 23 bp, Homo sapiens
caacaaatcacagtctgccatat

SEQ ID NO: 46380 - DNA, 21 bp, Homo sapiens
aacaaatcacagtctgccata

SEQ ID NO: 46381 - DNA, 21 bp, Homo sapiens
caacaaatcacagtctgccat

SEQ ID NO: 46382 - DNA, 22 bp, Homo sapiens
acaacaaatcacagtctgccat

SEQ ID NO: 46383 - DNA, 20 bp, Homo sapiens
caacaaatcacagtctgcca

SEQ ID NO: 46384 - DNA, 18 bp, Homo sapiens
aacaaatcacagtctgcc

SEQ ID NO: 46385 - DNA, 19 bp, Homo sapiens
caacaaatcacagtctgcc

SEQ ID NO: 46386 - DNA, 18 bp, Homo sapiens
caacaaatcacagtctgc

SEQ ID NO: 46387 - DNA, 21 bp, Homo sapiens
tagtgattttgttgtttttag

SEQ ID NO: 46388 - DNA, 25 bp, Homo sapiens
agactagtgattttgttgtttttag

SEQ ID NO: 46389 - DNA, 24 bp, Homo sapiens
agactagtgattttgttgttttta

SEQ ID NO: 46390 - DNA, 28 bp, Homo sapiens
tggaagactagtgattttgttgttttta

SEQ ID NO: 46391 - DNA, 23 bp, Homo sapiens
agactagtgattttgttgttttt

SEQ ID NO: 46392 - DNA, 27 bp, Homo sapiens
tggaagactagtgattttgttgttttt

SEQ ID NO: 46393 - DNA, 23 bp, Homo sapiens
aagactagtgattttgttgtttt

SEQ ID NO: 46394 - DNA, 24 bp, Homo sapiens
gaagactagtgattttgttgtttt

SEQ ID NO: 46395 - DNA, 26 bp, Homo sapiens
tggaagactagtgattttgttgtttt

SEQ ID NO: 46396 - DNA, 18 bp, Homo sapiens
ctagtgattttgttgttt

SEQ ID NO: 46397 - DNA, 19 bp, Homo sapiens
actagtgattttgttgttt

SEQ ID NO: 46398 - DNA, 21 bp, Homo sapiens
agactagtgattttgttgttt

SEQ ID NO: 46399 - DNA, 25 bp, Homo sapiens
tggaagactagtgattttgttgttt

SEQ ID NO: 46400 - DNA, 24 bp, Homo sapiens
tggaagactagtgattttgttgtt

SEQ ID NO: 46401 - DNA, 22 bp, Homo sapiens
tggaagactagtgattttgttg

SEQ ID NO: 46402 - DNA, 23 bp, Homo sapiens
gagggcattgtgcagggctatca

SEQ ID NO: 46403 - DNA, 17 bp, Homo sapiens
cattgtgcagggctatc

SEQ ID NO: 46404 - DNA, 22 bp, Homo sapiens
gagggcattgtgcagggctatc

SEQ ID NO: 46405 - DNA, 16 bp, Homo sapiens
cattgtgcagggctat

SEQ ID NO: 46406 - DNA, 21 bp, Homo sapiens
gagggcattgtgcagggctat

SEQ ID NO: 46407 - DNA, 16 bp, Homo sapiens
gcattgtgcagggcta

SEQ ID NO: 46408 - DNA, 18 bp, Homo sapiens
agattgggggaaagcgag

SEQ ID NO: 46409 - DNA, 21 bp, Homo sapiens
ttgggggaaagcgagtaggga

SEQ ID NO: 46410 - DNA, 20 bp, Homo sapiens
ggggaaagcgagtagggaca

SEQ ID NO: 46411 - DNA, 22 bp, Homo sapiens
ggggaaagcgagtagggacatt

SEQ ID NO: 46412 - DNA, 22 bp, Homo sapiens
gggaaagcgagtagggacattt

SEQ ID NO: 46413 - DNA, 23 bp, Homo sapiens
gggaaagcgagtagggacattta

SEQ ID NO: 46414 - DNA, 21 bp, Homo sapiens
ggaaagcgagtagggacattt

SEQ ID NO: 46415 - DNA, 22 bp, Homo sapiens
ggaaagcgagtagggacattta

SEQ ID NO: 46416 - DNA, 24 bp, Homo sapiens
ggaaagcgagtagggacatttaaa

SEQ ID NO: 46417 - DNA, 18 bp, Homo sapiens
aagcgagtagggacattt

SEQ ID NO: 46418 - DNA, 21 bp, Homo sapiens
cgagtagggacatttaaaatt

SEQ ID NO: 46419 - DNA, 24 bp, Homo sapiens
gttgccctcctttcttccctcacc

SEQ ID NO: 46420 - DNA, 21 bp, Homo sapiens
aaaggcataaaaccaagacaa

SEQ ID NO: 46421 - DNA, 20 bp, Homo sapiens
ataaaaccaagacaagcaac

SEQ ID NO: 46422 - DNA, 18 bp, Homo sapiens
aaaaccaagacaagcaac

SEQ ID NO: 46423 - DNA, 20 bp, Homo sapiens
cggtcgctggtacatgattc

SEQ ID NO: 46424 - DNA, 21 bp, Homo sapiens
ccggtcgctggtacatgattc

SEQ ID NO: 46425 - DNA, 22 bp, Homo sapiens
cccggtcgctggtacatgattc

SEQ ID NO: 46426 - DNA, 26 bp, Homo sapiens
atagcccggtcgctggtacatgattc

SEQ ID NO: 46427 - DNA, 27 bp, Homo sapiens
catagcccggtcgctggtacatgattc

SEQ ID NO: 46428 - DNA, 19 bp, Homo sapiens
cggtcgctggtacatgatt

SEQ ID NO: 46429 - DNA, 28 bp, Homo sapiens
gccatagcccggtcgctggtacatgatt

SEQ ID NO: 46430 - DNA, 24 bp, Homo sapiens
atagcccggtcgctggtacatgat

SEQ ID NO: 46431 - DNA, 16 bp, Homo sapiens
ggtcgctggtacatga

SEQ ID NO: 46432 - DNA, 17 bp, Homo sapiens
cggtcgctggtacatga

SEQ ID NO: 46433 - DNA, 18 bp, Homo sapiens
ccggtcgctggtacatga

SEQ ID NO: 46434 - DNA, 19 bp, Homo sapiens
cccggtcgctggtacatga

SEQ ID NO: 46435 - DNA, 20 bp, Homo sapiens
gcccggtcgctggtacatga

SEQ ID NO: 46436 - DNA, 21 bp, Homo sapiens
agcccggtcgctggtacatga

SEQ ID NO: 46437 - DNA, 22 bp, Homo sapiens
tagcccggtcgctggtacatga

SEQ ID NO: 46438 - DNA, 23 bp, Homo sapiens
atagcccggtcgctggtacatga

SEQ ID NO: 46439 - DNA, 25 bp, Homo sapiens
ccatagcccggtcgctggtacatga

SEQ ID NO: 46440 - DNA, 26 bp, Homo sapiens
gccatagcccggtcgctggtacatga

SEQ ID NO: 46441 - DNA, 27 bp, Homo sapiens
tgccatagcccggtcgctggtacatga

SEQ ID NO: 46442 - DNA, 28 bp, Homo sapiens
ctgccatagcccggtcgctggtacatga

SEQ ID NO: 46443 - DNA, 20 bp, Homo sapiens
agcccggtcgctggtacatg

SEQ ID NO: 46444 - DNA, 23 bp, Homo sapiens
gccatagcccggtcgctggtaca

SEQ ID NO: 46445 - DNA, 22 bp, Homo sapiens
gccatagcccggtcgctggtac

SEQ ID NO: 46446 - DNA, 21 bp, Homo sapiens
agctgccatagcccggtcgct

SEQ ID NO: 46447 - DNA, 20 bp, Homo sapiens
catcatggtcgcttcctaga

SEQ ID NO: 46448 - DNA, 25 bp, Homo sapiens
tctgaagttacatcatggtcgcttc

SEQ ID NO: 46449 - DNA, 22 bp, Homo sapiens
ctgaagttacatcatggtcgct

SEQ ID NO: 46450 - DNA, 23 bp, Homo sapiens
tctgaagttacatcatggtcgct

SEQ ID NO: 46451 - DNA, 22 bp, Homo sapiens
tctgaagttacatcatggtcgc

SEQ ID NO: 46452 - DNA, 21 bp, Homo sapiens
tctgaagttacatcatggtcg

SEQ ID NO: 46453 - DNA, 24 bp, Homo sapiens
gaccatgatgtaacttcacagact

SEQ ID NO: 46454 - DNA, 22 bp, Homo sapiens
gaccatgatgtaacttcacaga

SEQ ID NO: 46455 - DNA, 24 bp, Homo sapiens
gcgaccatgatgtaacttcacaga

SEQ ID NO: 46456 - DNA, 20 bp, Homo sapiens
gaccatgatgtaacttcaca

SEQ ID NO: 46457 - DNA, 22 bp, Homo sapiens
gcgaccatgatgtaacttcaca

SEQ ID NO: 46458 - DNA, 20 bp, Homo sapiens
tggcagttacttttgcacca

SEQ ID NO: 46459 - DNA, 22 bp, Homo sapiens
tggcagttacttttgcaccagc

SEQ ID NO: 46460 - DNA, 23 bp, Homo sapiens
tggcagttacttttgcaccagcc

SEQ ID NO: 46461 - DNA, 22 bp, Homo sapiens
atgaggtagtaggttgtatagt

SEQ ID NO: 46462 - DNA, 23 bp, Homo sapiens
atgaggtagtaggttgtatagtt

SEQ ID NO: 46463 - DNA, 24 bp, Homo sapiens
tgaggtagtaggttgtatagtttt

SEQ ID NO: 46464 - DNA, 25 bp, Homo sapiens
tgaggtagtaggttgtatagtttta

SEQ ID NO: 46465 - DNA, 26 bp, Homo sapiens
tgaggtagtaggttgtatagttttag

SEQ ID NO: 46466 - DNA, 27 bp, Homo sapiens
tgaggtagtaggttgtatagttttagg

SEQ ID NO: 46467 - DNA, 28 bp, Homo sapiens
tgaggtagtaggttgtatagttttaggg

SEQ ID NO: 46468 - DNA, 23 bp, Homo sapiens
gaggtagtaggttgtatagtttt

SEQ ID NO: 46469 - DNA, 20 bp, Homo sapiens
gtagtaggttgtatagtttt

SEQ ID NO: 46470 - DNA, 22 bp, Homo sapiens
tagtaggttgtatagttttagg

SEQ ID NO: 46471 - DNA, 19 bp, Homo sapiens
agataactatacaatctac

SEQ ID NO: 46472 - DNA, 20 bp, Homo sapiens
agataactatacaatctact

SEQ ID NO: 46473 - DNA, 21 bp, Homo sapiens
agataactatacaatctactg

SEQ ID NO: 46474 - DNA, 22 bp, Homo sapiens
agataactatacaatctactgt

SEQ ID NO: 46475 - DNA, 23 bp, Homo sapiens
agataactatacaatctactgtc

SEQ ID NO: 46476 - DNA, 28 bp, Homo sapiens
agataactatacaatctactgtctttcc

SEQ ID NO: 46477 - DNA, 24 bp, Homo sapiens
ctatacaatctactgtctttccta

SEQ ID NO: 46478 - DNA, 25 bp, Homo sapiens
ctatacaatctactgtctttcctaa

SEQ ID NO: 46479 - DNA, 26 bp, Homo sapiens
ctatacaatctactgtctttcctaac

SEQ ID NO: 46480 - DNA, 27 bp, Homo sapiens
ctatacaatctactgtctttcctaacg

SEQ ID NO: 46481 - DNA, 23 bp, Homo sapiens
tatacaatctactgtctttccta

SEQ ID NO: 46482 - DNA, 24 bp, Homo sapiens
tatacaatctactgtctttcctaa

SEQ ID NO: 46483 - DNA, 25 bp, Homo sapiens
tatacaatctactgtctttcctaac

SEQ ID NO: 46484 - DNA, 22 bp, Homo sapiens
atacaatctactgtctttccta

SEQ ID NO: 46485 - DNA, 23 bp, Homo sapiens
atacaatctactgtctttcctaa

SEQ ID NO: 46486 - DNA, 24 bp, Homo sapiens
atacaatctactgtctttcctaac

SEQ ID NO: 46487 - DNA, 23 bp, Homo sapiens
tacaatctactgtctttcctaac

SEQ ID NO: 46488 - DNA, 25 bp, Homo sapiens
gagtgaggtagtagattgtatagtt

SEQ ID NO: 46489 - DNA, 20 bp, Homo sapiens
agtgaggtagtagattgtat

SEQ ID NO: 46490 - DNA, 23 bp, Homo sapiens
gtgaggtagtagattgtatagtt

SEQ ID NO: 46491 - DNA, 21 bp, Homo sapiens
tgaggtagtagattgtatagt

SEQ ID NO: 46492 - DNA, 23 bp, Homo sapiens
tgaggtagtagattgtatagttg

SEQ ID NO: 46493 - DNA, 24 bp, Homo sapiens
tgaggtagtagattgtatagttgt

SEQ ID NO: 46494 - DNA, 25 bp, Homo sapiens
tgaggtagtagattgtatagttgtg

SEQ ID NO: 46495 - DNA, 26 bp, Homo sapiens
tgaggtagtagattgtatagttgtgg

SEQ ID NO: 46496 - DNA, 27 bp, Homo sapiens
tgaggtagtagattgtatagttgtggg

SEQ ID NO: 46497 - DNA, 28 bp, Homo sapiens
tgaggtagtagattgtatagttgtgggg

SEQ ID NO: 46498 - DNA, 24 bp, Homo sapiens
gaggtagtagattgtatagttgtg

SEQ ID NO: 46499 - DNA, 21 bp, Homo sapiens
aggtagtagattgtatagttg

SEQ ID NO: 46500 - DNA, 22 bp, Homo sapiens
aggtagtagattgtatagttgt

SEQ ID NO: 46501 - DNA, 23 bp, Homo sapiens
tagtagattgtatagttgtgggg

SEQ ID NO: 46502 - DNA, 20 bp, Homo sapiens
agataactatacaatctatt

SEQ ID NO: 46503 - DNA, 26 bp, Homo sapiens
agataactatacaatctattgccttc

SEQ ID NO: 46504 - DNA, 22 bp, Homo sapiens
aactatacaatctattgccttc

SEQ ID NO: 46505 - DNA, 17 bp, Homo sapiens
ctatacaatctattgcc

SEQ ID NO: 46506 - DNA, 19 bp, Homo sapiens
ctatacaatctattgcctt

SEQ ID NO: 46507 - DNA, 20 bp, Homo sapiens
ctatacaatctattgccttc

SEQ ID NO: 46508 - DNA, 21 bp, Homo sapiens
ctatacaatctattgccttcc

SEQ ID NO: 46509 - DNA, 23 bp, Homo sapiens
ctatacaatctattgccttccct

SEQ ID NO: 46510 - DNA, 25 bp, Homo sapiens
ctatacaatctattgccttccctga

SEQ ID NO: 46511 - DNA, 19 bp, Homo sapiens
agaggtagtaggttgcata

SEQ ID NO: 46512 - DNA, 20 bp, Homo sapiens
agaggtagtaggttgcatag

SEQ ID NO: 46513 - DNA, 21 bp, Homo sapiens
agaggtagtaggttgcatagt

SEQ ID NO: 46514 - DNA, 23 bp, Homo sapiens
agaggtagtaggttgcatagttt

SEQ ID NO: 46515 - DNA, 24 bp, Homo sapiens
agaggtagtaggttgcatagtttt

SEQ ID NO: 46516 - DNA, 26 bp, Homo sapiens
agaggtagtaggttgcatagttttag

SEQ ID NO: 46517 - DNA, 27 bp, Homo sapiens
agaggtagtaggttgcatagttttagg

SEQ ID NO: 46518 - DNA, 16 bp, Homo sapiens
ctatacgacctgctgc

SEQ ID NO: 46519 - DNA, 20 bp, Homo sapiens
ctatacgacctgctgccttt

SEQ ID NO: 46520 - DNA, 21 bp, Homo sapiens
ctatacgacctgctgcctttc

SEQ ID NO: 46521 - DNA, 23 bp, Homo sapiens
ctatacgacctgctgcctttctt

SEQ ID NO: 46522 - DNA, 24 bp, Homo sapiens
ctatacgacctgctgcctttctta

SEQ ID NO: 46523 - DNA, 27 bp, Homo sapiens
ctatacgacctgctgcctttcttaggg

SEQ ID NO: 46524 - DNA, 21 bp, Homo sapiens
tatacgacctgctgcctttct

SEQ ID NO: 46525 - DNA, 23 bp, Homo sapiens
tatacgacctgctgcctttctta

SEQ ID NO: 46526 - DNA, 26 bp, Homo sapiens
tatacgacctgctgcctttcttaggg

SEQ ID NO: 46527 - DNA, 23 bp, Homo sapiens
gagagcagtgtgtgttgcctggg

SEQ ID NO: 46528 - DNA, 24 bp, Homo sapiens
gagagcagtgtgtgttgcctgggg

SEQ ID NO: 46529 - DNA, 19 bp, Homo sapiens
agagcagtgtgtgttgcct

SEQ ID NO: 46530 - DNA, 20 bp, Homo sapiens
agagcagtgtgtgttgcctg

SEQ ID NO: 46531 - DNA, 21 bp, Homo sapiens
agagcagtgtgtgttgcctgg

SEQ ID NO: 46532 - DNA, 22 bp, Homo sapiens
agagcagtgtgtgttgcctggg

SEQ ID NO: 46533 - DNA, 23 bp, Homo sapiens
agagcagtgtgtgttgcctgggg

SEQ ID NO: 46534 - DNA, 24 bp, Homo sapiens
agagcagtgtgtgttgcctgggga

SEQ ID NO: 46535 - DNA, 25 bp, Homo sapiens
agagcagtgtgtgttgcctggggac

SEQ ID NO: 46536 - DNA, 17 bp, Homo sapiens
taggagcagtgccggcc

SEQ ID NO: 46537 - DNA, 16 bp, Homo sapiens
aggagcagtgccggcc

SEQ ID NO: 46538 - DNA, 16 bp, Homo sapiens
ccaaggcgccggcacc

SEQ ID NO: 46539 - DNA, 21 bp, Homo sapiens
ttgggttcctggcatgctgat

SEQ ID NO: 46540 - DNA, 22 bp, Homo sapiens
ttgggttcctggcatgctgatt

SEQ ID NO: 46541 - DNA, 24 bp, Homo sapiens
ttgggttcctggcatgctgatttg

SEQ ID NO: 46542 - DNA, 27 bp, Homo sapiens
ttgggttcctggcatgctgatttgtga

SEQ ID NO: 46543 - DNA, 20 bp, Homo sapiens
tgggttcctggcatgctgat

SEQ ID NO: 46544 - DNA, 21 bp, Homo sapiens
tgggttcctggcatgctgatt

SEQ ID NO: 46545 - DNA, 23 bp, Homo sapiens
tgggttcctggcatgctgatttg

SEQ ID NO: 46546 - DNA, 24 bp, Homo sapiens
tgggttcctggcatgctgatttgt

SEQ ID NO: 46547 - DNA, 26 bp, Homo sapiens
tgggttcctggcatgctgatttgtga

SEQ ID NO: 46548 - DNA, 18 bp, Homo sapiens
gggttcctggcatgctga

SEQ ID NO: 46549 - DNA, 19 bp, Homo sapiens
gggttcctggcatgctgat

SEQ ID NO: 46550 - DNA, 20 bp, Homo sapiens
gggttcctggcatgctgatt

SEQ ID NO: 46551 - DNA, 21 bp, Homo sapiens
gggttcctggcatgctgattt

SEQ ID NO: 46552 - DNA, 22 bp, Homo sapiens
gggttcctggcatgctgatttg

SEQ ID NO: 46553 - DNA, 23 bp, Homo sapiens
gggttcctggcatgctgatttgt

SEQ ID NO: 46554 - DNA, 24 bp, Homo sapiens
gggttcctggcatgctgatttgtg

SEQ ID NO: 46555 - DNA, 27 bp, Homo sapiens
gggttcctggcatgctgatttgtgact

SEQ ID NO: 46556 - DNA, 19 bp, Homo sapiens
atcacattgccagggatta

SEQ ID NO: 46557 - DNA, 20 bp, Homo sapiens
atcacattgccagggattac

SEQ ID NO: 46558 - DNA, 22 bp, Homo sapiens
atcacattgccagggattacca

SEQ ID NO: 46559 - DNA, 23 bp, Homo sapiens
atcacattgccagggattaccac

SEQ ID NO: 46560 - DNA, 24 bp, Homo sapiens
atcacattgccagggattaccacg

SEQ ID NO: 46561 - DNA, 22 bp, Homo sapiens
cagagcttagctgattggtgaa

SEQ ID NO: 46562 - DNA, 23 bp, Homo sapiens
cagagcttagctgattggtgaac

SEQ ID NO: 46563 - DNA, 24 bp, Homo sapiens
cagagcttagctgattggtgaaca

SEQ ID NO: 46564 - DNA, 16 bp, Homo sapiens
agagcttagctgattg

SEQ ID NO: 46565 - DNA, 17 bp, Homo sapiens
agagcttagctgattgg

SEQ ID NO: 46566 - DNA, 19 bp, Homo sapiens
agagcttagctgattggtg

SEQ ID NO: 46567 - DNA, 20 bp, Homo sapiens
agagcttagctgattggtga

SEQ ID NO: 46568 - DNA, 21 bp, Homo sapiens
agagcttagctgattggtgaa

SEQ ID NO: 46569 - DNA, 23 bp, Homo sapiens
agagcttagctgattggtgaaca

SEQ ID NO: 46570 - DNA, 24 bp, Homo sapiens
agagcttagctgattggtgaacag

SEQ ID NO: 46571 - DNA, 25 bp, Homo sapiens
agagcttagctgattggtgaacagt

SEQ ID NO: 46572 - DNA, 25 bp, Homo sapiens
gttcacagtggctaagttctgcacc

SEQ ID NO: 46573 - DNA, 19 bp, Homo sapiens
ttcacagtggctaagttct

SEQ ID NO: 46574 - DNA, 20 bp, Homo sapiens
ttcacagtggctaagttctg

SEQ ID NO: 46575 - DNA, 22 bp, Homo sapiens
ttcacagtggctaagttctgca

SEQ ID NO: 46576 - DNA, 23 bp, Homo sapiens
ttcacagtggctaagttctgcac

SEQ ID NO: 46577 - DNA, 24 bp, Homo sapiens
ttcacagtggctaagttctgcacc

SEQ ID NO: 46578 - DNA, 27 bp, Homo sapiens
ttcacagtggctaagttctgcacctga

SEQ ID NO: 46579 - DNA, 25 bp, Homo sapiens
gatatcagctcagtaggcaccggag

SEQ ID NO: 46580 - DNA, 24 bp, Homo sapiens
gatatcagctcagtaggcaccgga

SEQ ID NO: 46581 - DNA, 25 bp, Homo sapiens
tgatatcagctcagtaggcaccgga

SEQ ID NO: 46582 - DNA, 23 bp, Homo sapiens
gatatcagctcagtaggcaccgg

SEQ ID NO: 46583 - DNA, 24 bp, Homo sapiens
tgatatcagctcagtaggcaccgg

SEQ ID NO: 46584 - DNA, 19 bp, Homo sapiens
atcagctcagtaggcaccg

SEQ ID NO: 46585 - DNA, 23 bp, Homo sapiens
tgatatcagctcagtaggcaccg

SEQ ID NO: 46586 - DNA, 20 bp, Homo sapiens
ggtgcctactgagctgatat

SEQ ID NO: 46587 - DNA, 21 bp, Homo sapiens
gatatcagctcagtaggcacc

SEQ ID NO: 46588 - DNA, 21 bp, Homo sapiens
ggtgcctactgagctgatatc

SEQ ID NO: 46589 - DNA, 22 bp, Homo sapiens
ggtgcctactgagctgatatca

SEQ ID NO: 46590 - DNA, 23 bp, Homo sapiens
ggtgcctactgagctgatatcag

SEQ ID NO: 46591 - DNA, 24 bp, Homo sapiens
ggtgcctactgagctgatatcagt

SEQ ID NO: 46592 - DNA, 26 bp, Homo sapiens
ggtgcctactgagctgatatcagttc

SEQ ID NO: 46593 - DNA, 20 bp, Homo sapiens
gatatcagctcagtaggcac

SEQ ID NO: 46594 - DNA, 20 bp, Homo sapiens
gtgcctactgagctgatatc

SEQ ID NO: 46595 - DNA, 21 bp, Homo sapiens
tgatatcagctcagtaggcac

SEQ ID NO: 46596 - DNA, 21 bp, Homo sapiens
gtgcctactgagctgatatca

SEQ ID NO: 46597 - DNA, 22 bp, Homo sapiens
gtgcctactgagctgatatcag

SEQ ID NO: 46598 - DNA, 23 bp, Homo sapiens
gtgcctactgagctgatatcagt

SEQ ID NO: 46599 - DNA, 25 bp, Homo sapiens
gtgcctactgagctgatatcagttc

SEQ ID NO: 46600 - DNA, 28 bp, Homo sapiens
gtgcctactgagctgatatcagttctca

SEQ ID NO: 46601 - DNA, 19 bp, Homo sapiens
gatatcagctcagtaggca

SEQ ID NO: 46602 - DNA, 20 bp, Homo sapiens
tgcctactgagctgatatca

SEQ ID NO: 46603 - DNA, 24 bp, Homo sapiens
tgcctactgagctgatatcagttc

SEQ ID NO: 46604 - DNA, 27 bp, Homo sapiens
tgcctactgagctgatatcagttctca

SEQ ID NO: 46605 - DNA, 24 bp, Homo sapiens
ttcctgctgaactgagccagtgtg

SEQ ID NO: 46606 - DNA, 26 bp, Homo sapiens
tgttcctgctgaactgagccagtgtg

SEQ ID NO: 46607 - DNA, 25 bp, Homo sapiens
ctggctcagttcagcaggaacagga

SEQ ID NO: 46608 - DNA, 23 bp, Homo sapiens
tggctcagttcagcaggaacagg

SEQ ID NO: 46609 - DNA, 24 bp, Homo sapiens
tggctcagttcagcaggaacagga

SEQ ID NO: 46610 - DNA, 25 bp, Homo sapiens
tggctcagttcagcaggaacaggag

SEQ ID NO: 46611 - DNA, 26 bp, Homo sapiens
tggctcagttcagcaggaacaggagt

SEQ ID NO: 46612 - DNA, 27 bp, Homo sapiens
tggctcagttcagcaggaacaggagtc

SEQ ID NO: 46613 - DNA, 23 bp, Homo sapiens
ggctcagttcagcaggaacagga

SEQ ID NO: 46614 - DNA, 22 bp, Homo sapiens
gctcagttcagcaggaacagga

SEQ ID NO: 46615 - DNA, 24 bp, Homo sapiens
gctcagttcagcaggaacaggagt

SEQ ID NO: 46616 - DNA, 25 bp, Homo sapiens
gctcagttcagcaggaacaggagtc

SEQ ID NO: 46617 - DNA, 21 bp, Homo sapiens
aaaaggcattgtggtttttgc

SEQ ID NO: 46618 - DNA, 22 bp, Homo sapiens
aaaaggcattgtggtttttgcc

SEQ ID NO: 46619 - DNA, 20 bp, Homo sapiens
acccggtgaggcgggggggc

SEQ ID NO: 46620 - DNA, 21 bp, Homo sapiens
acccggtgaggcgggggggcg

SEQ ID NO: 46621 - DNA, 22 bp, Homo sapiens
acccggtgaggcgggggggcga

SEQ ID NO: 46622 - DNA, 23 bp, Homo sapiens
acccggtgaggcgggggggcgag

SEQ ID NO: 46623 - DNA, 24 bp, Homo sapiens
acccggtgaggcgggggggcgagc

SEQ ID NO: 46624 - DNA, 19 bp, Homo sapiens
cccggtgaggcgggggggc

SEQ ID NO: 46625 - DNA, 20 bp, Homo sapiens
cccggtgaggcgggggggcg

SEQ ID NO: 46626 - DNA, 21 bp, Homo sapiens
cccggtgaggcgggggggcga

SEQ ID NO: 46627 - DNA, 22 bp, Homo sapiens
cccggtgaggcgggggggcgag

SEQ ID NO: 46628 - DNA, 23 bp, Homo sapiens
cccggtgaggcgggggggcgagc

SEQ ID NO: 46629 - DNA, 18 bp, Homo sapiens
ccggtgaggcgggggggc

SEQ ID NO: 46630 - DNA, 20 bp, Homo sapiens
ccggtgaggcgggggggcga

SEQ ID NO: 46631 - DNA, 21 bp, Homo sapiens
ccggtgaggcgggggggcgag

SEQ ID NO: 46632 - DNA, 22 bp, Homo sapiens
ccggtgaggcgggggggcgagc

SEQ ID NO: 46633 - DNA, 17 bp, Homo sapiens
cggtgaggcgggggggc

SEQ ID NO: 46634 - DNA, 19 bp, Homo sapiens
cggtgaggcgggggggcga

SEQ ID NO: 46635 - DNA, 22 bp, Homo sapiens
cggtgaggcgggggggcgagcc

SEQ ID NO: 46636 - DNA, 18 bp, Homo sapiens
ggtgaggcgggggggcga

SEQ ID NO: 46637 - DNA, 25 bp, Homo sapiens
ggtgaggcgggggggcgagccctga

SEQ ID NO: 46638 - DNA, 18 bp, Homo sapiens
gtgaggcgggggggcgag

SEQ ID NO: 46639 - DNA, 17 bp, Homo sapiens
gaggcgggggggcgagc

SEQ ID NO: 46640 - DNA, 19 bp, Homo sapiens
gaggcgggggggcgagccc

SEQ ID NO: 46641 - DNA, 16 bp, Homo sapiens
aggcgggggggcgagc

SEQ ID NO: 46642 - DNA, 18 bp, Homo sapiens
aggcgggggggcgagccc

SEQ ID NO: 46643 - DNA, 17 bp, Homo sapiens
gcgggggggcgagccct

SEQ ID NO: 46644 - DNA, 17 bp, Homo sapiens
cgggggggcgagccctg

SEQ ID NO: 46645 - DNA, 18 bp, Homo sapiens
cgggggggcgagccctga

SEQ ID NO: 46646 - DNA, 17 bp, Homo sapiens
acaaccctaggagaggg

SEQ ID NO: 46647 - DNA, 18 bp, Homo sapiens
acaaccctaggagagggt

SEQ ID NO: 46648 - DNA, 19 bp, Homo sapiens
acaaccctaggagagggtg

SEQ ID NO: 46649 - DNA, 20 bp, Homo sapiens
acaaccctaggagagggtgc

SEQ ID NO: 46650 - DNA, 21 bp, Homo sapiens
acaaccctaggagagggtgcc

SEQ ID NO: 46651 - DNA, 22 bp, Homo sapiens
acaaccctaggagagggtgcca

SEQ ID NO: 46652 - DNA, 23 bp, Homo sapiens
acaaccctaggagagggtgccat

SEQ ID NO: 46653 - DNA, 24 bp, Homo sapiens
acaaccctaggagagggtgccatt

SEQ ID NO: 46654 - DNA, 25 bp, Homo sapiens
acaaccctaggagagggtgccattc

SEQ ID NO: 46655 - DNA, 26 bp, Homo sapiens
acaaccctaggagagggtgccattca

SEQ ID NO: 46656 - DNA, 28 bp, Homo sapiens
acaaccctaggagagggtgccattcaca

SEQ ID NO: 46657 - DNA, 19 bp, Homo sapiens
caaccctaggagagggtgc

SEQ ID NO: 46658 - DNA, 23 bp, Homo sapiens
caaccctaggagagggtgccatt

SEQ ID NO: 46659 - DNA, 24 bp, Homo sapiens
caaccctaggagagggtgccattc

SEQ ID NO: 46660 - DNA, 28 bp, Homo sapiens
caaccctaggagagggtgccattcacat

SEQ ID NO: 46661 - DNA, 16 bp, Homo sapiens
aatggcgccactaggg

SEQ ID NO: 46662 - DNA, 18 bp, Homo sapiens
aatggcgccactagggtt

SEQ ID NO: 46663 - DNA, 19 bp, Homo sapiens
aatggcgccactagggttg

SEQ ID NO: 46664 - DNA, 20 bp, Homo sapiens
aatggcgccactagggttgt

SEQ ID NO: 46665 - DNA, 22 bp, Homo sapiens
aatggcgccactagggttgtgc

SEQ ID NO: 46666 - DNA, 23 bp, Homo sapiens
aatggcgccactagggttgtgca

SEQ ID NO: 46667 - DNA, 24 bp, Homo sapiens
aatggcgccactagggttgtgcag

SEQ ID NO: 46668 - DNA, 21 bp, Homo sapiens
atggcgccactagggttgtgc

SEQ ID NO: 46669 - DNA, 22 bp, Homo sapiens
ctcctgagaccctagttccaca

SEQ ID NO: 46670 - DNA, 21 bp, Homo sapiens
ctcctgagaccctagttccac

SEQ ID NO: 46671 - DNA, 19 bp, Homo sapiens
ctcctgagaccctagttcc

SEQ ID NO: 46672 - DNA, 17 bp, Homo sapiens
ctcctgagaccctagtt

SEQ ID NO: 46673 - DNA, 25 bp, Homo sapiens
agaagtaattgcggttttgccatgg

SEQ ID NO: 46674 - DNA, 22 bp, Homo sapiens
gaagtaattgcggttttgccat

SEQ ID NO: 46675 - DNA, 23 bp, Homo sapiens
agaagtaattgcggttttgccat

SEQ ID NO: 46676 - DNA, 21 bp, Homo sapiens
gaagtaattgcggttttgcca

SEQ ID NO: 46677 - DNA, 21 bp, Homo sapiens
agaagtaattgcggttttgcc

SEQ ID NO: 46678 - DNA, 20 bp, Homo sapiens
agaagtaattgcggttttgc

SEQ ID NO: 46679 - DNA, 21 bp, Homo sapiens
ggtgctcacttgtcctcctcc

SEQ ID NO: 46680 - DNA, 22 bp, Homo sapiens
ggtgctcacttgtcctcctcca

SEQ ID NO: 46681 - DNA, 23 bp, Homo sapiens
ggtgctcacttgtcctcctccat

SEQ ID NO: 46682 - DNA, 20 bp, Homo sapiens
caatacccagagcatgcagt

SEQ ID NO: 46683 - DNA, 22 bp, Homo sapiens
atacccagagcatgcagtgtga

SEQ ID NO: 46684 - DNA, 19 bp, Homo sapiens
tacccagagcatgcagtgt

SEQ ID NO: 46685 - DNA, 20 bp, Homo sapiens
tacccagagcatgcagtgtg

SEQ ID NO: 46686 - DNA, 21 bp, Homo sapiens
tacccagagcatgcagtgtga

SEQ ID NO: 46687 - DNA, 23 bp, Homo sapiens
tacccagagcatgcagtgtgaac

SEQ ID NO: 46688 - DNA, 21 bp, Homo sapiens
cccagagcatgcagtgtgaac

SEQ ID NO: 46689 - DNA, 22 bp, Homo sapiens
ccagagcatgcagtgtgaacat

SEQ ID NO: 46690 - DNA, 23 bp, Homo sapiens
acaagtcttatttgagcacctgt

SEQ ID NO: 46691 - DNA, 21 bp, Homo sapiens
caagtcttatttgagcacctg

SEQ ID NO: 46692 - DNA, 22 bp, Homo sapiens
caagtcttatttgagcacctgt

SEQ ID NO: 46693 - DNA, 24 bp, Homo sapiens
caagtcttatttgagcacctgtta

SEQ ID NO: 46694 - DNA, 26 bp, Homo sapiens
aagagttcattcggctgtccagatgt

SEQ ID NO: 46695 - DNA, 21 bp, Homo sapiens
agagttcattcggctgtccag

SEQ ID NO: 46696 - DNA, 23 bp, Homo sapiens
gttcattcggctgtccagatgta

SEQ ID NO: 46697 - DNA, 16 bp, Homo sapiens
ttcattcggctgtcca

SEQ ID NO: 46698 - DNA, 20 bp, Homo sapiens
ttcattcggctgtccagatg

SEQ ID NO: 46699 - DNA, 21 bp, Homo sapiens
ttcattcggctgtccagatgt

SEQ ID NO: 46700 - DNA, 23 bp, Homo sapiens
ttcattcggctgtccagatgtat

SEQ ID NO: 46701 - DNA, 24 bp, Homo sapiens
ttcattcggctgtccagatgtatc

SEQ ID NO: 46702 - DNA, 26 bp, Homo sapiens
ttcattcggctgtccagatgtatcca

SEQ ID NO: 46703 - DNA, 22 bp, Homo sapiens
tcattcggctgtccagatgtat

SEQ ID NO: 46704 - DNA, 22 bp, Homo sapiens
atacatctgggcaactgactga

SEQ ID NO: 46705 - DNA, 19 bp, Homo sapiens
catctgggcaactgactga

SEQ ID NO: 46706 - DNA, 20 bp, Homo sapiens
catctgggcaactgactgaa

SEQ ID NO: 46707 - DNA, 22 bp, Homo sapiens
catctgggcaactgactgaact

SEQ ID NO: 46708 - DNA, 24 bp, Homo sapiens
catctgggcaactgactgaacttt

SEQ ID NO: 46709 - DNA, 21 bp, Homo sapiens
tctgggcaactgactgaactt

SEQ ID NO: 46710 - DNA, 21 bp, Homo sapiens
tgggcaactgactgaactttt

SEQ ID NO: 46711 - DNA, 18 bp, Homo sapiens
atctgctgagtaccgcca

SEQ ID NO: 46712 - DNA, 19 bp, Homo sapiens
atctgctgagtaccgccat

SEQ ID NO: 46713 - DNA, 20 bp, Homo sapiens
atctgctgagtaccgccatg

SEQ ID NO: 46714 - DNA, 21 bp, Homo sapiens
atctgctgagtaccgccatgt

SEQ ID NO: 46715 - DNA, 22 bp, Homo sapiens
atctgctgagtaccgccatgtc

SEQ ID NO: 46716 - DNA, 23 bp, Homo sapiens
atctgctgagtaccgccatgtct

SEQ ID NO: 46717 - DNA, 16 bp, Homo sapiens
tgagtaccgccatgtc

SEQ ID NO: 46718 - DNA, 19 bp, Homo sapiens
tgagtaccgccatgtctgt

SEQ ID NO: 46719 - DNA, 20 bp, Homo sapiens
tgagtaccgccatgtctgtt

SEQ ID NO: 46720 - DNA, 21 bp, Homo sapiens
tgagtaccgccatgtctgttg

SEQ ID NO: 46721 - DNA, 22 bp, Homo sapiens
tgagtaccgccatgtctgttgg

SEQ ID NO: 46722 - DNA, 24 bp, Homo sapiens
tgagtaccgccatgtctgttgggc

SEQ ID NO: 46723 - DNA, 27 bp, Homo sapiens
tgagtaccgccatgtctgttgggcatc

SEQ ID NO: 46724 - DNA, 22 bp, Homo sapiens
gagtaccgccatgtctgttggg

SEQ ID NO: 46725 - DNA, 21 bp, Homo sapiens
caccaggcattgtggtctccg

SEQ ID NO: 46726 - DNA, 22 bp, Homo sapiens
caccaggcattgtggtctccgc

SEQ ID NO: 46727 - DNA, 23 bp, Homo sapiens
caccaggcattgtggtctccgct

SEQ ID NO: 46728 - DNA, 20 bp, Homo sapiens
gttgcatatgtaggatgtcc

SEQ ID NO: 46729 - DNA, 23 bp, Homo sapiens
gttgcatatgtaggatgtcccat

SEQ ID NO: 46730 - DNA, 19 bp, Homo sapiens
ttgcatatgtaggatgtcc

SEQ ID NO: 46731 - DNA, 20 bp, Homo sapiens
ttgcatatgtaggatgtccc

SEQ ID NO: 46732 - DNA, 21 bp, Homo sapiens
ttgcatatgtaggatgtccca

SEQ ID NO: 46733 - DNA, 23 bp, Homo sapiens
ttgcatatgtaggatgtcccatc

SEQ ID NO: 46734 - DNA, 26 bp, Homo sapiens
ttgcatatgtaggatgtcccatctcc

SEQ ID NO: 46735 - DNA, 16 bp, Homo sapiens
atatgtaggatgtccc

SEQ ID NO: 46736 - DNA, 18 bp, Homo sapiens
aggatgtcccatctccca

SEQ ID NO: 46737 - DNA, 24 bp, Homo sapiens
tatatatatatatgtacgtatgtg

SEQ ID NO: 46738 - DNA, 22 bp, Homo sapiens
atacgtagatatatatgtattt

SEQ ID NO: 46739 - DNA, 23 bp, Homo sapiens
atacgtagatatatatgtatttt

SEQ ID NO: 46740 - DNA, 20 bp, Homo sapiens
tacgtagatatatatgtatt

SEQ ID NO: 46741 - DNA, 21 bp, Homo sapiens
tacgtagatatatatgtattt

SEQ ID NO: 46742 - DNA, 23 bp, Homo sapiens
tacgtagatatatatgtattttt

SEQ ID NO: 46743 - DNA, 24 bp, Homo sapiens
tacgtagatatatatgtatttttg

SEQ ID NO: 46744 - DNA, 25 bp, Homo sapiens
tacgtagatatatatgtatttttgg

SEQ ID NO: 46745 - DNA, 26 bp, Homo sapiens
tacgtagatatatatgtatttttggt

SEQ ID NO: 46746 - DNA, 27 bp, Homo sapiens
tacgtagatatatatgtatttttggtg

SEQ ID NO: 46747 - DNA, 20 bp, Homo sapiens
acgtagatatatatgtattt

SEQ ID NO: 46748 - DNA, 19 bp, Homo sapiens
cgtagatatatatgtattt

SEQ ID NO: 46749 - DNA, 25 bp, Homo sapiens
actccagccccacagcctcagccac

SEQ ID NO: 46750 - DNA, 24 bp, Homo sapiens
actccagccccacagcctcagcca

SEQ ID NO: 46751 - DNA, 23 bp, Homo sapiens
actccagccccacagcctcagcc

SEQ ID NO: 46752 - DNA, 21 bp, Homo sapiens
ctccagccccacagcctcagc

SEQ ID NO: 46753 - DNA, 21 bp, Homo sapiens
actccagccccacagcctcag

SEQ ID NO: 46754 - DNA, 20 bp, Homo sapiens
actccagccccacagcctca

SEQ ID NO: 46755 - DNA, 26 bp, Homo sapiens
ggaggaattggtgctggtctttcatt

SEQ ID NO: 46756 - DNA, 27 bp, Homo sapiens
aggaggaattggtgctggtctttcatt

SEQ ID NO: 46757 - DNA, 24 bp, Homo sapiens
ggaggaattggtgctggtctttca

SEQ ID NO: 46758 - DNA, 25 bp, Homo sapiens
aggaggaattggtgctggtctttca

SEQ ID NO: 46759 - DNA, 23 bp, Homo sapiens
ggaggaattggtgctggtctttc

SEQ ID NO: 46760 - DNA, 24 bp, Homo sapiens
aggaggaattggtgctggtctttc

SEQ ID NO: 46761 - DNA, 23 bp, Homo sapiens
aggaggaattggtgctggtcttt

SEQ ID NO: 46762 - DNA, 21 bp, Homo sapiens
ggaggaattggtgctggtctt

SEQ ID NO: 46763 - DNA, 21 bp, Homo sapiens
aggaggaattggtgctggtct

SEQ ID NO: 46764 - DNA, 22 bp, Homo sapiens
taggaggaattggtgctggtct

SEQ ID NO: 46765 - DNA, 19 bp, Homo sapiens
aggaggaattggtgctggt

SEQ ID NO: 46766 - DNA, 20 bp, Homo sapiens
ccatgagactcatgtaaaac

SEQ ID NO: 46767 - DNA, 23 bp, Homo sapiens
catgagactcatgtaaaacatct

SEQ ID NO: 46768 - DNA, 20 bp, Homo sapiens
atgagactcatgtaaaacat

SEQ ID NO: 46769 - DNA, 22 bp, Homo sapiens
atgagactcatgtaaaacatct

SEQ ID NO: 46770 - DNA, 16 bp, Homo sapiens
aaaacatcttagacta

SEQ ID NO: 46771 - DNA, 26 bp, Homo sapiens
aattgcacggtatccatctgtaaacc

SEQ ID NO: 46772 - DNA, 24 bp, Homo sapiens
attgcacggtatccatctgtaaac

SEQ ID NO: 46773 - DNA, 25 bp, Homo sapiens
aattgcacggtatccatctgtaaac

SEQ ID NO: 46774 - DNA, 24 bp, Homo sapiens
aattgcacggtatccatctgtaaa

SEQ ID NO: 46775 - DNA, 22 bp, Homo sapiens
attgcacggtatccatctgtaa

SEQ ID NO: 46776 - DNA, 23 bp, Homo sapiens
aattgcacggtatccatctgtaa

SEQ ID NO: 46777 - DNA, 21 bp, Homo sapiens
attgcacggtatccatctgta

SEQ ID NO: 46778 - DNA, 20 bp, Homo sapiens
attgcacggtatccatctgt

SEQ ID NO: 46779 - DNA, 21 bp, Homo sapiens
aattgcacggtatccatctgt

SEQ ID NO: 46780 - DNA, 20 bp, Homo sapiens
aattgcacggtatccatctg

SEQ ID NO: 46781 - DNA, 19 bp, Homo sapiens
aattgcacggtatccatct

SEQ ID NO: 46782 - DNA, 17 bp, Homo sapiens
aattgcacggtatccat

SEQ ID NO: 46783 - DNA, 16 bp, Homo sapiens
aattgcacggtatcca

SEQ ID NO: 46784 - DNA, 22 bp, Homo sapiens
gggtggatcacgatgcaatttt

SEQ ID NO: 46785 - DNA, 23 bp, Homo sapiens
cgggtggatcacgatgcaatttt

SEQ ID NO: 46786 - DNA, 21 bp, Homo sapiens
gggtggatcacgatgcaattt

SEQ ID NO: 46787 - DNA, 20 bp, Homo sapiens
gggtggatcacgatgcaatt

SEQ ID NO: 46788 - DNA, 21 bp, Homo sapiens
cgggtggatcacgatgcaatt

SEQ ID NO: 46789 - DNA, 20 bp, Homo sapiens
cgggtggatcacgatgcaat

SEQ ID NO: 46790 - DNA, 19 bp, Homo sapiens
cgggtggatcacgatgcaa

SEQ ID NO: 46791 - DNA, 18 bp, Homo sapiens
cgggtggatcacgatgca

SEQ ID NO: 46792 - DNA, 26 bp, Homo sapiens
tattgcacttgtcccggcctgtggaa

SEQ ID NO: 46793 - DNA, 25 bp, Homo sapiens
tattgcacttgtcccggcctgtgga

SEQ ID NO: 46794 - DNA, 23 bp, Homo sapiens
attgcacttgtcccggcctgtgg

SEQ ID NO: 46795 - DNA, 24 bp, Homo sapiens
tattgcacttgtcccggcctgtgg

SEQ ID NO: 46796 - DNA, 22 bp, Homo sapiens
attgcacttgtcccggcctgtg

SEQ ID NO: 46797 - DNA, 23 bp, Homo sapiens
tattgcacttgtcccggcctgtg

SEQ ID NO: 46798 - DNA, 22 bp, Homo sapiens
tggggatttgttgcattacttg

SEQ ID NO: 46799 - DNA, 24 bp, Homo sapiens
gggtggggatttgttgcattactt

SEQ ID NO: 46800 - DNA, 23 bp, Homo sapiens
gggtggggatttgttgcattact

SEQ ID NO: 46801 - DNA, 23 bp, Homo sapiens
tgggtggggatttgttgcattac

SEQ ID NO: 46802 - DNA, 21 bp, Homo sapiens
gggtggggatttgttgcatta

SEQ ID NO: 46803 - DNA, 27 bp, Homo sapiens
tgtgcaaatccatgcaaaactgattgt

SEQ ID NO: 46804 - DNA, 26 bp, Homo sapiens
tgtgcaaatccatgcaaaactgattg

SEQ ID NO: 46805 - DNA, 24 bp, Homo sapiens
gtgcaaatccatgcaaaactgatt

SEQ ID NO: 46806 - DNA, 25 bp, Homo sapiens
tgtgcaaatccatgcaaaactgatt

SEQ ID NO: 46807 - DNA, 20 bp, Homo sapiens
caaatccatgcaaaactgat

SEQ ID NO: 46808 - DNA, 23 bp, Homo sapiens
gtgcaaatccatgcaaaactgat

SEQ ID NO: 46809 - DNA, 24 bp, Homo sapiens
tgtgcaaatccatgcaaaactgat

SEQ ID NO: 46810 - DNA, 26 bp, Homo sapiens
ggctgtgcaaatccatgcaaaactga

SEQ ID NO: 46811 - DNA, 27 bp, Homo sapiens
tggctgtgcaaatccatgcaaaactga

SEQ ID NO: 46812 - DNA, 25 bp, Homo sapiens
agttttgcaggtttgcatttcagcg

SEQ ID NO: 46813 - DNA, 24 bp, Homo sapiens
agttttgcaggtttgcatttcagc

SEQ ID NO: 46814 - DNA, 23 bp, Homo sapiens
agttttgcaggtttgcatttcag

SEQ ID NO: 46815 - DNA, 23 bp, Homo sapiens
tagttttgcaggtttgcatttca

SEQ ID NO: 46816 - DNA, 20 bp, Homo sapiens
gttttgcaggtttgcatttc

SEQ ID NO: 46817 - DNA, 21 bp, Homo sapiens
agttttgcaggtttgcatttc

SEQ ID NO: 46818 - DNA, 20 bp, Homo sapiens
agttttgcaggtttgcattt

SEQ ID NO: 46819 - DNA, 19 bp, Homo sapiens
agttttgcaggtttgcatt

SEQ ID NO: 46820 - DNA, 25 bp, Homo sapiens
actgtagtatgggcacttccagtac

SEQ ID NO: 46821 - DNA, 24 bp, Homo sapiens
actgtagtatgggcacttccagta

SEQ ID NO: 46822 - DNA, 23 bp, Homo sapiens
actgtagtatgggcacttccagt

SEQ ID NO: 46823 - DNA, 21 bp, Homo sapiens
actgtagtatgggcacttcca

SEQ ID NO: 46824 - DNA, 20 bp, Homo sapiens
actgtagtatgggcacttcc

SEQ ID NO: 46825 - DNA, 19 bp, Homo sapiens
tactgtagtatgggcactt

SEQ ID NO: 46826 - DNA, 20 bp, Homo sapiens
tctactgtagtatgggcact

SEQ ID NO: 46827 - DNA, 26 bp, Homo sapiens
caaagtgctcatagtgcaggtagttt

SEQ ID NO: 46828 - DNA, 25 bp, Homo sapiens
caaagtgctcatagtgcaggtagtt

SEQ ID NO: 46829 - DNA, 24 bp, Homo sapiens
caaagtgctcatagtgcaggtagt

SEQ ID NO: 46830 - DNA, 22 bp, Homo sapiens
aaagtgctcatagtgcaggtag

SEQ ID NO: 46831 - DNA, 22 bp, Homo sapiens
caaagtgctcatagtgcaggta

SEQ ID NO: 46832 - DNA, 21 bp, Homo sapiens
caaagtgctcatagtgcaggt

SEQ ID NO: 46833 - DNA, 20 bp, Homo sapiens
caaagtgctcatagtgcagg

SEQ ID NO: 46834 - DNA, 19 bp, Homo sapiens
caaagtgctcatagtgcag

SEQ ID NO: 46835 - DNA, 18 bp, Homo sapiens
caaagtgctcatagtgca

SEQ ID NO: 46836 - DNA, 26 bp, Homo sapiens
tactgccctaaatgccccttctggca

SEQ ID NO: 46837 - DNA, 24 bp, Homo sapiens
actgccctaaatgccccttctggc

SEQ ID NO: 46838 - DNA, 25 bp, Homo sapiens
tactgccctaaatgccccttctggc

SEQ ID NO: 46839 - DNA, 21 bp, Homo sapiens
tgccctaaatgccccttctgg

SEQ ID NO: 46840 - DNA, 23 bp, Homo sapiens
actgccctaaatgccccttctgg

SEQ ID NO: 46841 - DNA, 24 bp, Homo sapiens
tactgccctaaatgccccttctgg

SEQ ID NO: 46842 - DNA, 22 bp, Homo sapiens
actgccctaaatgccccttctg

SEQ ID NO: 46843 - DNA, 23 bp, Homo sapiens
tactgccctaaatgccccttctg

SEQ ID NO: 46844 - DNA, 21 bp, Homo sapiens
actgccctaaatgccccttct

SEQ ID NO: 46845 - DNA, 22 bp, Homo sapiens
tactgccctaaatgccccttct

SEQ ID NO: 46846 - DNA, 18 bp, Homo sapiens
tgccctaaatgccccttc

SEQ ID NO: 46847 - DNA, 21 bp, Homo sapiens
tactgccctaaatgccccttc

SEQ ID NO: 46848 - DNA, 19 bp, Homo sapiens
actgccctaaatgcccctt

SEQ ID NO: 46849 - DNA, 20 bp, Homo sapiens
tactgccctaaatgcccctt

SEQ ID NO: 46850 - DNA, 19 bp, Homo sapiens
tactgccctaaatgcccct

SEQ ID NO: 46851 - DNA, 18 bp, Homo sapiens
tactgccctaaatgcccc

SEQ ID NO: 46852 - DNA, 17 bp, Homo sapiens
tactgccctaaatgccc

SEQ ID NO: 46853 - DNA, 25 bp, Homo sapiens
taaggtgcatctagtgcagttagtg

SEQ ID NO: 46854 - DNA, 24 bp, Homo sapiens
taaggtgcatctagtgcagttagt

SEQ ID NO: 46855 - DNA, 22 bp, Homo sapiens
taaggtgcatctagtgcagtta

SEQ ID NO: 46856 - DNA, 21 bp, Homo sapiens
taaggtgcatctagtgcagtt

SEQ ID NO: 46857 - DNA, 20 bp, Homo sapiens
taaggtgcatctagtgcagt

SEQ ID NO: 46858 - DNA, 25 bp, Homo sapiens
ctgcaatgtaagcacttcttacatt

SEQ ID NO: 46859 - DNA, 26 bp, Homo sapiens
actgcaatgtaagcacttcttacatt

SEQ ID NO: 46860 - DNA, 23 bp, Homo sapiens
actgcaatgtaagcacttcttac

SEQ ID NO: 46861 - DNA, 24 bp, Homo sapiens
tactgcaatgtaagcacttcttac

SEQ ID NO: 46862 - DNA, 22 bp, Homo sapiens
actgcaatgtaagcacttctta

SEQ ID NO: 46863 - DNA, 23 bp, Homo sapiens
tactgcaatgtaagcacttctta

SEQ ID NO: 46864 - DNA, 20 bp, Homo sapiens
ctgcaatgtaagcacttctt

SEQ ID NO: 46865 - DNA, 21 bp, Homo sapiens
actgcaatgtaagcacttctt

SEQ ID NO: 46866 - DNA, 22 bp, Homo sapiens
tactgcaatgtaagcacttctt

SEQ ID NO: 46867 - DNA, 20 bp, Homo sapiens
actgcaatgtaagcacttct

SEQ ID NO: 46868 - DNA, 21 bp, Homo sapiens
tactgcaatgtaagcacttct

SEQ ID NO: 46869 - DNA, 22 bp, Homo sapiens
ctactgcaatgtaagcacttct

SEQ ID NO: 46870 - DNA, 19 bp, Homo sapiens
actgcaatgtaagcacttc

SEQ ID NO: 46871 - DNA, 20 bp, Homo sapiens
tactgcaatgtaagcacttc

SEQ ID NO: 46872 - DNA, 19 bp, Homo sapiens
tactgcaatgtaagcactt

SEQ ID NO: 46873 - DNA, 18 bp, Homo sapiens
tactgcaatgtaagcact

SEQ ID NO: 46874 - DNA, 26 bp, Homo sapiens
aaagtgcttacagtgcaggtagcttt

SEQ ID NO: 46875 - DNA, 25 bp, Homo sapiens
aaagtgcttacagtgcaggtagctt

SEQ ID NO: 46876 - DNA, 19 bp, Homo sapiens
gcttacagtgcaggtagct

SEQ ID NO: 46877 - DNA, 21 bp, Homo sapiens
gtgcttacagtgcaggtagct

SEQ ID NO: 46878 - DNA, 24 bp, Homo sapiens
aaagtgcttacagtgcaggtagct

SEQ ID NO: 46879 - DNA, 25 bp, Homo sapiens
aaaagtgcttacagtgcaggtagct

SEQ ID NO: 46880 - DNA, 23 bp, Homo sapiens
aaagtgcttacagtgcaggtagc

SEQ ID NO: 46881 - DNA, 24 bp, Homo sapiens
aaaagtgcttacagtgcaggtagc

SEQ ID NO: 46882 - DNA, 22 bp, Homo sapiens
aaaagtgcttacagtgcaggta

SEQ ID NO: 46883 - DNA, 21 bp, Homo sapiens
aaaagtgcttacagtgcaggt

SEQ ID NO: 46884 - DNA, 20 bp, Homo sapiens
aaaagtgcttacagtgcagg

SEQ ID NO: 46885 - DNA, 19 bp, Homo sapiens
aaaagtgcttacagtgcag

SEQ ID NO: 46886 - DNA, 18 bp, Homo sapiens
aaaagtgcttacagtgca

SEQ ID NO: 46887 - DNA, 23 bp, Homo sapiens
attgggatcattttgcatccata

SEQ ID NO: 46888 - DNA, 20 bp, Homo sapiens
tgggatcattttgcatccat

SEQ ID NO: 46889 - DNA, 21 bp, Homo sapiens
ttgggatcattttgcatccat

SEQ ID NO: 46890 - DNA, 22 bp, Homo sapiens
attgggatcattttgcatccat

SEQ ID NO: 46891 - DNA, 21 bp, Homo sapiens
attgggatcattttgcatcca

SEQ ID NO: 46892 - DNA, 22 bp, Homo sapiens
tattgggatcattttgcatcca

SEQ ID NO: 46893 - DNA, 18 bp, Homo sapiens
ttgggatcattttgcatc

SEQ ID NO: 46894 - DNA, 20 bp, Homo sapiens
tattgggatcattttgcatc

SEQ ID NO: 46895 - DNA, 18 bp, Homo sapiens
attgggatcattttgcat

SEQ ID NO: 46896 - DNA, 25 bp, Homo sapiens
ttttgcaatatgttcctgaatatgt

SEQ ID NO: 46897 - DNA, 24 bp, Homo sapiens
ttttgcaatatgttcctgaatatg

SEQ ID NO: 46898 - DNA, 22 bp, Homo sapiens
tttgcaatatgttcctgaatat

SEQ ID NO: 46899 - DNA, 23 bp, Homo sapiens
ttttgcaatatgttcctgaatat

SEQ ID NO: 46900 - DNA, 20 bp, Homo sapiens
tttgcaatatgttcctgaat

SEQ ID NO: 46901 - DNA, 21 bp, Homo sapiens
ttttgcaatatgttcctgaat

SEQ ID NO: 46902 - DNA, 20 bp, Homo sapiens
ttttgcaatatgttcctgaa

SEQ ID NO: 46903 - DNA, 19 bp, Homo sapiens
ttttgcaatatgttcctga

SEQ ID NO: 46904 - DNA, 27 bp, Homo sapiens
ttttgcgatgtgttcctaatatgcact

SEQ ID NO: 46905 - DNA, 26 bp, Homo sapiens
ttttgcgatgtgttcctaatatgcac

SEQ ID NO: 46906 - DNA, 25 bp, Homo sapiens
ttttgcgatgtgttcctaatatgca

SEQ ID NO: 46907 - DNA, 22 bp, Homo sapiens
ttgcgatgtgttcctaatatgc

SEQ ID NO: 46908 - DNA, 23 bp, Homo sapiens
tttgcgatgtgttcctaatatgc

SEQ ID NO: 46909 - DNA, 24 bp, Homo sapiens
ttttgcgatgtgttcctaatatgc

SEQ ID NO: 46910 - DNA, 24 bp, Homo sapiens
gtttttgcgatgtgttcctaatat

SEQ ID NO: 46911 - DNA, 22 bp, Homo sapiens
ttggggacattttgcattcata

SEQ ID NO: 46912 - DNA, 22 bp, Homo sapiens
ttggggacattttgcattcata

SEQ ID NO: 46913 - DNA, 23 bp, Homo sapiens
attggggacattttgcattcata

SEQ ID NO: 46914 - DNA, 23 bp, Homo sapiens
attggggacattttgcattcata

SEQ ID NO: 46915 - DNA, 24 bp, Homo sapiens
tattggggacattttgcattcata

SEQ ID NO: 46916 - DNA, 24 bp, Homo sapiens
tattggggacattttgcattcata

SEQ ID NO: 46917 - DNA, 21 bp, Homo sapiens
ttggggacattttgcattcat

SEQ ID NO: 46918 - DNA, 21 bp, Homo sapiens
ttggggacattttgcattcat

SEQ ID NO: 46919 - DNA, 23 bp, Homo sapiens
tattggggacattttgcattcat

SEQ ID NO: 46920 - DNA, 23 bp, Homo sapiens
tattggggacattttgcattcat

SEQ ID NO: 46921 - DNA, 18 bp, Homo sapiens
ggggacattttgcattca

SEQ ID NO: 46922 - DNA, 18 bp, Homo sapiens
ggggacattttgcattca

SEQ ID NO: 46923 - DNA, 20 bp, Homo sapiens
ttggggacattttgcattca

SEQ ID NO: 46924 - DNA, 20 bp, Homo sapiens
ttggggacattttgcattca

SEQ ID NO: 46925 - DNA, 21 bp, Homo sapiens
attggggacattttgcattca

SEQ ID NO: 46926 - DNA, 21 bp, Homo sapiens
attggggacattttgcattca

SEQ ID NO: 46927 - DNA, 22 bp, Homo sapiens
tattggggacattttgcattca

SEQ ID NO: 46928 - DNA, 22 bp, Homo sapiens
tattggggacattttgcattca

SEQ ID NO: 46929 - DNA, 19 bp, Homo sapiens
ttggggacattttgcattc

SEQ ID NO: 46930 - DNA, 19 bp, Homo sapiens
ttggggacattttgcattc

SEQ ID NO: 46931 - DNA, 20 bp, Homo sapiens
attggggacattttgcattc

SEQ ID NO: 46932 - DNA, 20 bp, Homo sapiens
attggggacattttgcattc

SEQ ID NO: 46933 - DNA, 18 bp, Homo sapiens
ttggggacattttgcatt

SEQ ID NO: 46934 - DNA, 18 bp, Homo sapiens
ttggggacattttgcatt

SEQ ID NO: 46935 - DNA, 19 bp, Homo sapiens
aaatgtattggggacattt

SEQ ID NO: 46936 - DNA, 19 bp, Homo sapiens
aaatgtattggggacattt

SEQ ID NO: 46937 - DNA, 28 bp, Homo sapiens
ttttgcgatgtgttcctaatatgtaata

SEQ ID NO: 46938 - DNA, 27 bp, Homo sapiens
ttttgcgatgtgttcctaatatgtaat

SEQ ID NO: 46939 - DNA, 25 bp, Homo sapiens
ttttgcgatgtgttcctaatatgta

SEQ ID NO: 46940 - DNA, 21 bp, Homo sapiens
tgcgatgtgttcctaatatgt

SEQ ID NO: 46941 - DNA, 23 bp, Homo sapiens
tttgcgatgtgttcctaatatgt

SEQ ID NO: 46942 - DNA, 24 bp, Homo sapiens
ttttgcgatgtgttcctaatatgt

SEQ ID NO: 46943 - DNA, 22 bp, Homo sapiens
ctatttttgcgatgtgttccta

SEQ ID NO: 46944 - DNA, 19 bp, Homo sapiens
actatttttgcgatgtgtt

SEQ ID NO: 46945 - DNA, 26 bp, Homo sapiens
tgtgacagattgataactgaaaggtc

SEQ ID NO: 46946 - DNA, 23 bp, Homo sapiens
tgtgacagattgataactgaaag

SEQ ID NO: 46947 - DNA, 23 bp, Homo sapiens
ttgtgacagattgataactgaaa

SEQ ID NO: 46948 - DNA, 21 bp, Homo sapiens
tgtgacagattgataactgaa

SEQ ID NO: 46949 - DNA, 22 bp, Homo sapiens
ttgtgacagattgataactgaa

SEQ ID NO: 46950 - DNA, 20 bp, Homo sapiens
tgtgacagattgataactga

SEQ ID NO: 46951 - DNA, 21 bp, Homo sapiens
ttgtgacagattgataactga

SEQ ID NO: 46952 - DNA, 19 bp, Homo sapiens
tgtgacagattgataactg

SEQ ID NO: 46953 - DNA, 19 bp, Homo sapiens
ttgtgacagattgataact

SEQ ID NO: 46954 - DNA, 28 bp, Homo sapiens
tcggggatcatcatgtcacgagatacca

SEQ ID NO: 46955 - DNA, 26 bp, Homo sapiens
tcggggatcatcatgtcacgagatac

SEQ ID NO: 46956 - DNA, 25 bp, Homo sapiens
tcggggatcatcatgtcacgagata

SEQ ID NO: 46957 - DNA, 26 bp, Homo sapiens
ctcggggatcatcatgtcacgagata

SEQ ID NO: 46958 - DNA, 24 bp, Homo sapiens
tcggggatcatcatgtcacgagat

SEQ ID NO: 46959 - DNA, 22 bp, Homo sapiens
tcggggatcatcatgtcacgag

SEQ ID NO: 46960 - DNA, 20 bp, Homo sapiens
cggggatcatcatgtcacga

SEQ ID NO: 46961 - DNA, 21 bp, Homo sapiens
tcggggatcatcatgtcacga

SEQ ID NO: 46962 - DNA, 22 bp, Homo sapiens
ctcggggatcatcatgtcacga

SEQ ID NO: 46963 - DNA, 20 bp, Homo sapiens
tcggggatcatcatgtcacg

SEQ ID NO: 46964 - DNA, 18 bp, Homo sapiens
tcggggatcatcatgtca

SEQ ID NO: 46965 - DNA, 26 bp, Homo sapiens
ggggtattgtttccgctgccagggta

SEQ ID NO: 46966 - DNA, 25 bp, Homo sapiens
ggggtattgtttccgctgccagggt

SEQ ID NO: 46967 - DNA, 23 bp, Homo sapiens
gggtattgtttccgctgccaggg

SEQ ID NO: 46968 - DNA, 24 bp, Homo sapiens
ggggtattgtttccgctgccaggg

SEQ ID NO: 46969 - DNA, 25 bp, Homo sapiens
tggggtattgtttccgctgccaggg

SEQ ID NO: 46970 - DNA, 22 bp, Homo sapiens
gggtattgtttccgctgccagg

SEQ ID NO: 46971 - DNA, 24 bp, Homo sapiens
tggggtattgtttccgctgccagg

SEQ ID NO: 46972 - DNA, 21 bp, Homo sapiens
gggtattgtttccgctgccag

SEQ ID NO: 46973 - DNA, 22 bp, Homo sapiens
ggggtattgtttccgctgccag

SEQ ID NO: 46974 - DNA, 23 bp, Homo sapiens
tggggtattgtttccgctgccag

SEQ ID NO: 46975 - DNA, 20 bp, Homo sapiens
gggtattgtttccgctgcca

SEQ ID NO: 46976 - DNA, 21 bp, Homo sapiens
ggggtattgtttccgctgcca

SEQ ID NO: 46977 - DNA, 20 bp, Homo sapiens
ggggtattgtttccgctgcc

SEQ ID NO: 46978 - DNA, 22 bp, Homo sapiens
ctggggtattgtttccgctgcc

SEQ ID NO: 46979 - DNA, 23 bp, Homo sapiens
tctggggtattgtttccgctgcc

SEQ ID NO: 46980 - DNA, 19 bp, Homo sapiens
ggggtattgtttccgctgc

SEQ ID NO: 46981 - DNA, 22 bp, Homo sapiens
tctggggtattgtttccgctgc

SEQ ID NO: 46982 - DNA, 17 bp, Homo sapiens
gggtattgtttccgctg

SEQ ID NO: 46983 - DNA, 21 bp, Homo sapiens
tctggggtattgtttccgctg

SEQ ID NO: 46984 - DNA, 17 bp, Homo sapiens
ggggtattgtttccgct

SEQ ID NO: 46985 - DNA, 21 bp, Homo sapiens
cagcgggaacagttctgcagt

SEQ ID NO: 46986 - DNA, 24 bp, Homo sapiens
tagcagcgggaacagttctgcagt

SEQ ID NO: 46987 - DNA, 20 bp, Homo sapiens
cagcgggaacagttctgcag

SEQ ID NO: 46988 - DNA, 19 bp, Homo sapiens
cagcgggaacagttctgca

SEQ ID NO: 46989 - DNA, 22 bp, Homo sapiens
tagcagcgggaacagttctgca

SEQ ID NO: 46990 - DNA, 18 bp, Homo sapiens
cagcgggaacagttctgc

SEQ ID NO: 46991 - DNA, 21 bp, Homo sapiens
tagcagcgggaacagttctgc

SEQ ID NO: 46992 - DNA, 17 bp, Homo sapiens
cagcgggaacagttctg

SEQ ID NO: 46993 - DNA, 20 bp, Homo sapiens
tagcagcgggaacagttctg

SEQ ID NO: 46994 - DNA, 16 bp, Homo sapiens
cagcgggaacagttct

SEQ ID NO: 46995 - DNA, 19 bp, Homo sapiens
tagcagcgggaacagttct

SEQ ID NO: 46996 - DNA, 22 bp, Homo sapiens
aaacgtgaggcgctgctatacc

SEQ ID NO: 46997 - DNA, 23 bp, Homo sapiens
aaaacgtgaggcgctgctatacc

SEQ ID NO: 46998 - DNA, 24 bp, Homo sapiens
caaaacgtgaggcgctgctatacc

SEQ ID NO: 46999 - DNA, 23 bp, Homo sapiens
caaaacgtgaggcgctgctatac

SEQ ID NO: 47000 - DNA, 21 bp, Homo sapiens
aaaacgtgaggcgctgctata

SEQ ID NO: 47001 - DNA, 22 bp, Homo sapiens
caaaacgtgaggcgctgctata

SEQ ID NO: 47002 - DNA, 20 bp, Homo sapiens
caaaacgtgaggcgctgcta

SEQ ID NO: 47003 - DNA, 19 bp, Homo sapiens
caaaacgtgaggcgctgct

SEQ ID NO: 47004 - DNA, 17 bp, Homo sapiens
aaaacgtgaggcgctgc

SEQ ID NO: 47005 - DNA, 17 bp, Homo sapiens
caaaacgtgaggcgctg

SEQ ID NO: 47006 - DNA, 16 bp, Homo sapiens
caaaacgtgaggcgct

SEQ ID NO: 47007 - DNA, 26 bp, Homo sapiens
cagcagcaattcatgttttgaagtgt

SEQ ID NO: 47008 - DNA, 24 bp, Homo sapiens
cagcagcaattcatgttttgaagt

SEQ ID NO: 47009 - DNA, 23 bp, Homo sapiens
cagcagcaattcatgttttgaag

SEQ ID NO: 47010 - DNA, 21 bp, Homo sapiens
agcagcaattcatgttttgaa

SEQ ID NO: 47011 - DNA, 21 bp, Homo sapiens
cagcagcaattcatgttttga

SEQ ID NO: 47012 - DNA, 20 bp, Homo sapiens
cagcagcaattcatgttttg

SEQ ID NO: 47013 - DNA, 19 bp, Homo sapiens
cagcagcaattcatgtttt

SEQ ID NO: 47014 - DNA, 18 bp, Homo sapiens
cagcagcaattcatgttt

SEQ ID NO: 47015 - DNA, 17 bp, Homo sapiens
tgtctactactggagac

SEQ ID NO: 47016 - DNA, 18 bp, Homo sapiens
tgtctactactggagaca

SEQ ID NO: 47017 - DNA, 20 bp, Homo sapiens
tgtctactactggagacact

SEQ ID NO: 47018 - DNA, 21 bp, Homo sapiens
tgtctactactggagacactg

SEQ ID NO: 47019 - DNA, 23 bp, Homo sapiens
tgtctactactggagacactggt

SEQ ID NO: 47020 - DNA, 24 bp, Homo sapiens
tgtctactactggagacactggta

SEQ ID NO: 47021 - DNA, 27 bp, Homo sapiens
tgtctactactggagacactggtagta

SEQ ID NO: 47022 - DNA, 24 bp, Homo sapiens
gggagtgcagggcagggtttccca

SEQ ID NO: 47023 - DNA, 27 bp, Homo sapiens
gaagggagtgcagggcagggtttccca

SEQ ID NO: 47024 - DNA, 23 bp, Homo sapiens
gggagtgcagggcagggtttccc

SEQ ID NO: 47025 - DNA, 24 bp, Homo sapiens
agggagtgcagggcagggtttccc

SEQ ID NO: 47026 - DNA, 22 bp, Homo sapiens
gggagtgcagggcagggtttcc

SEQ ID NO: 47027 - DNA, 23 bp, Homo sapiens
agggagtgcagggcagggtttcc

SEQ ID NO: 47028 - DNA, 24 bp, Homo sapiens
aagggagtgcagggcagggtttcc

SEQ ID NO: 47029 - DNA, 24 bp, Homo sapiens
gaagggagtgcagggcagggtttc

SEQ ID NO: 47030 - DNA, 18 bp, Homo sapiens
gagtgcagggcagggttt

SEQ ID NO: 47031 - DNA, 20 bp, Homo sapiens
gggagtgcagggcagggttt

SEQ ID NO: 47032 - DNA, 21 bp, Homo sapiens
agggagtgcagggcagggttt

SEQ ID NO: 47033 - DNA, 22 bp, Homo sapiens
aagggagtgcagggcagggttt

SEQ ID NO: 47034 - DNA, 24 bp, Homo sapiens
tgaagggagtgcagggcagggttt

SEQ ID NO: 47035 - DNA, 19 bp, Homo sapiens
gggagtgcagggcagggtt

SEQ ID NO: 47036 - DNA, 20 bp, Homo sapiens
agggagtgcagggcagggtt

SEQ ID NO: 47037 - DNA, 27 bp, Homo sapiens
gaccctggtctgcactctatctgtatt

SEQ ID NO: 47038 - DNA, 24 bp, Homo sapiens
gaccctggtctgcactctatctgt

SEQ ID NO: 47039 - DNA, 25 bp, Homo sapiens
agaccctggtctgcactctatctgt

SEQ ID NO: 47040 - DNA, 23 bp, Homo sapiens
gaccctggtctgcactctatctg

SEQ ID NO: 47041 - DNA, 22 bp, Homo sapiens
gaccctggtctgcactctatct

SEQ ID NO: 47042 - DNA, 23 bp, Homo sapiens
agaccctggtctgcactctatct

SEQ ID NO: 47043 - DNA, 21 bp, Homo sapiens
gaccctggtctgcactctatc

SEQ ID NO: 47044 - DNA, 20 bp, Homo sapiens
gaccctggtctgcactctat

SEQ ID NO: 47045 - DNA, 21 bp, Homo sapiens
agaccctggtctgcactctat

SEQ ID NO: 47046 - DNA, 20 bp, Homo sapiens
agaccctggtctgcactcta

SEQ ID NO: 47047 - DNA, 19 bp, Homo sapiens
agaccctggtctgcactct

SEQ ID NO: 47048 - DNA, 28 bp, Homo sapiens
cgtcaacacttgctggtttcctctctgg

SEQ ID NO: 47049 - DNA, 26 bp, Homo sapiens
cgtcaacacttgctggtttcctctct

SEQ ID NO: 47050 - DNA, 23 bp, Homo sapiens
tcaacacttgctggtttcctctc

SEQ ID NO: 47051 - DNA, 24 bp, Homo sapiens
gtcaacacttgctggtttcctctc

SEQ ID NO: 47052 - DNA, 25 bp, Homo sapiens
cgtcaacacttgctggtttcctctc

SEQ ID NO: 47053 - DNA, 22 bp, Homo sapiens
tcaacacttgctggtttcctct

SEQ ID NO: 47054 - DNA, 23 bp, Homo sapiens
gtcaacacttgctggtttcctct

SEQ ID NO: 47055 - DNA, 24 bp, Homo sapiens
cgtcaacacttgctggtttcctct

SEQ ID NO: 47056 - DNA, 23 bp, Homo sapiens
cgtcaacacttgctggtttcctc

SEQ ID NO: 47057 - DNA, 21 bp, Homo sapiens
gtcaacacttgctggtttcct

SEQ ID NO: 47058 - DNA, 20 bp, Homo sapiens
gtcaacacttgctggtttcc

SEQ ID NO: 47059 - DNA, 21 bp, Homo sapiens
cgtcaacacttgctggtttcc

SEQ ID NO: 47060 - DNA, 19 bp, Homo sapiens
cgtcaacacttgctggttt

SEQ ID NO: 47061 - DNA, 18 bp, Homo sapiens
cgtcaacacttgctggtt

SEQ ID NO: 47062 - DNA, 28 bp, Homo sapiens
gggagccaggaagtattgatgtttctgc

SEQ ID NO: 47063 - DNA, 27 bp, Homo sapiens
gggagccaggaagtattgatgtttctg

SEQ ID NO: 47064 - DNA, 25 bp, Homo sapiens
gggagccaggaagtattgatgtttc

SEQ ID NO: 47065 - DNA, 23 bp, Homo sapiens
ggagccaggaagtattgatgttt

SEQ ID NO: 47066 - DNA, 24 bp, Homo sapiens
gggagccaggaagtattgatgttt

SEQ ID NO: 47067 - DNA, 23 bp, Homo sapiens
gggagccaggaagtattgatgtt

SEQ ID NO: 47068 - DNA, 20 bp, Homo sapiens
gagccaggaagtattgatgt

SEQ ID NO: 47069 - DNA, 21 bp, Homo sapiens
gggagccaggaagtattgatg

SEQ ID NO: 47070 - DNA, 20 bp, Homo sapiens
gggagccaggaagtattgat

SEQ ID NO: 47071 - DNA, 19 bp, Homo sapiens
gggagccaggaagtattga

SEQ ID NO: 47072 - DNA, 24 bp, Homo sapiens
aaaagctgggttgagaggagcaga

SEQ ID NO: 47073 - DNA, 23 bp, Homo sapiens
aaaagctgggttgagaggagcag

SEQ ID NO: 47074 - DNA, 21 bp, Homo sapiens
aaagctgggttgagaggagca

SEQ ID NO: 47075 - DNA, 22 bp, Homo sapiens
aaaagctgggttgagaggagca

SEQ ID NO: 47076 - DNA, 23 bp, Homo sapiens
gaaaagctgggttgagaggagca

SEQ ID NO: 47077 - DNA, 20 bp, Homo sapiens
aaagctgggttgagaggagc

SEQ ID NO: 47078 - DNA, 21 bp, Homo sapiens
aaaagctgggttgagaggagc

SEQ ID NO: 47079 - DNA, 22 bp, Homo sapiens
gaaaagctgggttgagaggagc

SEQ ID NO: 47080 - DNA, 19 bp, Homo sapiens
aaagctgggttgagaggag

SEQ ID NO: 47081 - DNA, 20 bp, Homo sapiens
aaaagctgggttgagaggag

SEQ ID NO: 47082 - DNA, 21 bp, Homo sapiens
gaaaagctgggttgagaggag

SEQ ID NO: 47083 - DNA, 24 bp, Homo sapiens
tacttggaaaggcatcagttgctt

SEQ ID NO: 47084 - DNA, 23 bp, Homo sapiens
tacttggaaaggcatcagttgct

SEQ ID NO: 47085 - DNA, 22 bp, Homo sapiens
tacttggaaaggcatcagttgc

SEQ ID NO: 47086 - DNA, 23 bp, Homo sapiens
gactgacacctctttgggtgaag

SEQ ID NO: 47087 - DNA, 20 bp, Homo sapiens
tgactgacacctctttgggt

SEQ ID NO: 47088 - DNA, 25 bp, Homo sapiens
tactcaaaaagctgtcagtcactta

SEQ ID NO: 47089 - DNA, 23 bp, Homo sapiens
tactcaaaaagctgtcagtcact

SEQ ID NO: 47090 - DNA, 22 bp, Homo sapiens
tactcaaaaagctgtcagtcac

SEQ ID NO: 47091 - DNA, 20 bp, Homo sapiens
tactcaaaaagctgtcagtc

SEQ ID NO: 47092 - DNA, 19 bp, Homo sapiens
tactcaaaaagctgtcagt

SEQ ID NO: 47093 - DNA, 18 bp, Homo sapiens
tactcaaaaagctgtcag

SEQ ID NO: 47094 - DNA, 17 bp, Homo sapiens
tactcaaaaagctgtca

SEQ ID NO: 47095 - DNA, 24 bp, Homo sapiens
cactgtgtcctttctgcgtagagt

SEQ ID NO: 47096 - DNA, 23 bp, Homo sapiens
cactgtgtcctttctgcgtagag

SEQ ID NO: 47097 - DNA, 22 bp, Homo sapiens
cactgtgtcctttctgcgtaga

SEQ ID NO: 47098 - DNA, 20 bp, Homo sapiens
cactgtgtcctttctgcgta

SEQ ID NO: 47099 - DNA, 24 bp, Homo sapiens
cactggctcctttctgggtagagc

SEQ ID NO: 47100 - DNA, 25 bp, Homo sapiens
tcactggctcctttctgggtagagc

SEQ ID NO: 47101 - DNA, 20 bp, Homo sapiens
ctggctcctttctgggtaga

SEQ ID NO: 47102 - DNA, 23 bp, Homo sapiens
tcactggctcctttctgggtaga

SEQ ID NO: 47103 - DNA, 21 bp, Homo sapiens
cactggctcctttctgggtag

SEQ ID NO: 47104 - DNA, 22 bp, Homo sapiens
tcactggctcctttctgggtag

SEQ ID NO: 47105 - DNA, 25 bp, Homo sapiens
tgcaacttacctgagtcattgattc

SEQ ID NO: 47106 - DNA, 24 bp, Homo sapiens
tgcaacttacctgagtcattgatt

SEQ ID NO: 47107 - DNA, 22 bp, Homo sapiens
gcaacttacctgagtcattgat

SEQ ID NO: 47108 - DNA, 20 bp, Homo sapiens
caacttacctgagtcattga

SEQ ID NO: 47109 - DNA, 21 bp, Homo sapiens
gcaacttacctgagtcattga

SEQ ID NO: 47110 - DNA, 21 bp, Homo sapiens
tgcaacttacctgagtcattg

SEQ ID NO: 47111 - DNA, 20 bp, Homo sapiens
tgcaacttacctgagtcatt

SEQ ID NO: 47112 - DNA, 23 bp, Homo sapiens
agtggcacatgtttgttgtgagg

SEQ ID NO: 47113 - DNA, 20 bp, Homo sapiens
tggcacatgtttgttgtgag

SEQ ID NO: 47114 - DNA, 25 bp, Homo sapiens
tgcaacgaacctgagccactgattc

SEQ ID NO: 47115 - DNA, 26 bp, Homo sapiens
ttgcaacgaacctgagccactgattc

SEQ ID NO: 47116 - DNA, 24 bp, Homo sapiens
tgcaacgaacctgagccactgatt

SEQ ID NO: 47117 - DNA, 23 bp, Homo sapiens
tgcaacgaacctgagccactgat

SEQ ID NO: 47118 - DNA, 21 bp, Homo sapiens
gcaacgaacctgagccactga

SEQ ID NO: 47119 - DNA, 21 bp, Homo sapiens
tgcaacgaacctgagccactg

SEQ ID NO: 47120 - DNA, 20 bp, Homo sapiens
tgcaacgaacctgagccact

SEQ ID NO: 47121 - DNA, 17 bp, Homo sapiens
tgcaacgaacctgagcc

SEQ ID NO: 47122 - DNA, 23 bp, Homo sapiens
aaatttcacctttctgagaagag

SEQ ID NO: 47123 - DNA, 24 bp, Homo sapiens
taaatttcacctttctgagaagag

SEQ ID NO: 47124 - DNA, 22 bp, Homo sapiens
aaatttcacctttctgagaaga

SEQ ID NO: 47125 - DNA, 28 bp, Homo sapiens
ttctcaaggaggtgtcgtttatgtgaac

SEQ ID NO: 47126 - DNA, 25 bp, Homo sapiens
ttctcaaggaggtgtcgtttatgtg

SEQ ID NO: 47127 - DNA, 24 bp, Homo sapiens
ttctcaaggaggtgtcgtttatgt

SEQ ID NO: 47128 - DNA, 23 bp, Homo sapiens
ttctcaaggaggtgtcgtttatg

SEQ ID NO: 47129 - DNA, 21 bp, Homo sapiens
ttctcaaggaggtgtcgttta

SEQ ID NO: 47130 - DNA, 20 bp, Homo sapiens
ttctcaaggaggtgtcgttt

SEQ ID NO: 47131 - DNA, 19 bp, Homo sapiens
ttctcaaggaggtgtcgtt

SEQ ID NO: 47132 - DNA, 25 bp, Homo sapiens
taaatgtcacctttttgagaggagt

SEQ ID NO: 47133 - DNA, 23 bp, Homo sapiens
taaatgtcacctttttgagagga

SEQ ID NO: 47134 - DNA, 22 bp, Homo sapiens
taaatgtcacctttttgagagg

SEQ ID NO: 47135 - DNA, 20 bp, Homo sapiens
aaatgtcacctttttgagag

SEQ ID NO: 47136 - DNA, 25 bp, Homo sapiens
ttcacaaggaggtgtcatttatgtg

SEQ ID NO: 47137 - DNA, 24 bp, Homo sapiens
ttcacaaggaggtgtcatttatgt

SEQ ID NO: 47138 - DNA, 23 bp, Homo sapiens
ttcacaaggaggtgtcatttatg

SEQ ID NO: 47139 - DNA, 21 bp, Homo sapiens
ttcacaaggaggtgtcattta

SEQ ID NO: 47140 - DNA, 20 bp, Homo sapiens
ttcacaaggaggtgtcattt

SEQ ID NO: 47141 - DNA, 19 bp, Homo sapiens
ttcacaaggaggtgtcatt

SEQ ID NO: 47142 - DNA, 24 bp, Homo sapiens
gtaaggcacccttctgagtagagt

SEQ ID NO: 47143 - DNA, 25 bp, Homo sapiens
tgtaaggcacccttctgagtagagt

SEQ ID NO: 47144 - DNA, 23 bp, Homo sapiens
gtaaggcacccttctgagtagag

SEQ ID NO: 47145 - DNA, 24 bp, Homo sapiens
tgtaaggcacccttctgagtagag

SEQ ID NO: 47146 - DNA, 22 bp, Homo sapiens
gtaaggcacccttctgagtaga

SEQ ID NO: 47147 - DNA, 23 bp, Homo sapiens
tgtaaggcacccttctgagtaga

SEQ ID NO: 47148 - DNA, 21 bp, Homo sapiens
gtaaggcacccttctgagtag

SEQ ID NO: 47149 - DNA, 22 bp, Homo sapiens
tgtaaggcacccttctgagtag

SEQ ID NO: 47150 - DNA, 20 bp, Homo sapiens
gtaaggcacccttctgagta

SEQ ID NO: 47151 - DNA, 19 bp, Homo sapiens
gtaaggcacccttctgagt

SEQ ID NO: 47152 - DNA, 26 bp, Homo sapiens
tattcaggaaggtgttacttaataga

SEQ ID NO: 47153 - DNA, 24 bp, Homo sapiens
tattcaggaaggtgttacttaata

SEQ ID NO: 47154 - DNA, 21 bp, Homo sapiens
tattcaggaaggtgttactta

SEQ ID NO: 47155 - DNA, 24 bp, Homo sapiens
ttttgcaccttttggagtgaaata

SEQ ID NO: 47156 - DNA, 25 bp, Homo sapiens
gttttgcaccttttggagtgaaata

SEQ ID NO: 47157 - DNA, 26 bp, Homo sapiens
tgttttgcaccttttggagtgaaata

SEQ ID NO: 47158 - DNA, 23 bp, Homo sapiens
ttttgcaccttttggagtgaaat

SEQ ID NO: 47159 - DNA, 20 bp, Homo sapiens
ttttgcaccttttggagtga

SEQ ID NO: 47160 - DNA, 22 bp, Homo sapiens
tgttttgcaccttttggagtga

SEQ ID NO: 47161 - DNA, 18 bp, Homo sapiens
tttgcaccttttggagtg

SEQ ID NO: 47162 - DNA, 19 bp, Homo sapiens
ttttgcaccttttggagtg

SEQ ID NO: 47163 - DNA, 26 bp, Homo sapiens
tgattgtagccttttggagtagagta

SEQ ID NO: 47164 - DNA, 25 bp, Homo sapiens
tgattgtagccttttggagtagagt

SEQ ID NO: 47165 - DNA, 22 bp, Homo sapiens
attgtagccttttggagtagag

SEQ ID NO: 47166 - DNA, 24 bp, Homo sapiens
tgattgtagccttttggagtagag

SEQ ID NO: 47167 - DNA, 19 bp, Homo sapiens
tgtagccttttggagtaga

SEQ ID NO: 47168 - DNA, 21 bp, Homo sapiens
attgtagccttttggagtaga

SEQ ID NO: 47169 - DNA, 22 bp, Homo sapiens
gattgtagccttttggagtaga

SEQ ID NO: 47170 - DNA, 22 bp, Homo sapiens
tgattgtagccttttggagtag

SEQ ID NO: 47171 - DNA, 21 bp, Homo sapiens
tgattgtagccttttggagta

SEQ ID NO: 47172 - DNA, 19 bp, Homo sapiens
gattgtagccttttggagt

SEQ ID NO: 47173 - DNA, 20 bp, Homo sapiens
tgattgtagccttttggagt

SEQ ID NO: 47174 - DNA, 19 bp, Homo sapiens
tgattgtagccttttggag

SEQ ID NO: 47175 - DNA, 26 bp, Homo sapiens
tactccagagggcgtcactcatgtaa

SEQ ID NO: 47176 - DNA, 24 bp, Homo sapiens
tactccagagggcgtcactcatgt

SEQ ID NO: 47177 - DNA, 21 bp, Homo sapiens
actccagagggcgtcactcat

SEQ ID NO: 47178 - DNA, 22 bp, Homo sapiens
tactccagagggcgtcactcat

SEQ ID NO: 47179 - DNA, 21 bp, Homo sapiens
tactccagagggcgtcactca

SEQ ID NO: 47180 - DNA, 20 bp, Homo sapiens
tactccagagggcgtcactc

SEQ ID NO: 47181 - DNA, 19 bp, Homo sapiens
tactccagagggcgtcact

SEQ ID NO: 47182 - DNA, 23 bp, Homo sapiens
attgacacctctgtgagtggagt

SEQ ID NO: 47183 - DNA, 22 bp, Homo sapiens
attgacacctctgtgagtggag

SEQ ID NO: 47184 - DNA, 20 bp, Homo sapiens
attgacacctctgtgagtgg

SEQ ID NO: 47185 - DNA, 19 bp, Homo sapiens
attgacacctctgtgagtg

SEQ ID NO: 47186 - DNA, 18 bp, Homo sapiens
attgacacctctgtgagt

SEQ ID NO: 47187 - DNA, 23 bp, Homo sapiens
ttctcaagagggaggcaatcatg

SEQ ID NO: 47188 - DNA, 21 bp, Homo sapiens
ttctcaagagggaggcaatca

SEQ ID NO: 47189 - DNA, 20 bp, Homo sapiens
ttctcaagagggaggcaatc

SEQ ID NO: 47190 - DNA, 19 bp, Homo sapiens
ttctcaagagggaggcaat

SEQ ID NO: 47191 - DNA, 27 bp, Homo sapiens
tactgcagacgtggcaatcatgtataa

SEQ ID NO: 47192 - DNA, 26 bp, Homo sapiens
tactgcagacgtggcaatcatgtata

SEQ ID NO: 47193 - DNA, 25 bp, Homo sapiens
tactgcagacgtggcaatcatgtat

SEQ ID NO: 47194 - DNA, 22 bp, Homo sapiens
actgcagacgtggcaatcatgt

SEQ ID NO: 47195 - DNA, 23 bp, Homo sapiens
tactgcagacgtggcaatcatgt

SEQ ID NO: 47196 - DNA, 21 bp, Homo sapiens
tactgcagacgtggcaatcat

SEQ ID NO: 47197 - DNA, 20 bp, Homo sapiens
tactgcagacgtggcaatca

SEQ ID NO: 47198 - DNA, 23 bp, Homo sapiens
ccctactgcagacgtggcaatca

SEQ ID NO: 47199 - DNA, 19 bp, Homo sapiens
tactgcagacgtggcaatc

SEQ ID NO: 47200 - DNA, 18 bp, Homo sapiens
tactgcagacgtggcaat

SEQ ID NO: 47201 - DNA, 18 bp, Homo sapiens
gaaacctctaagagtgga

SEQ ID NO: 47202 - DNA, 21 bp, Homo sapiens
tgattgaaacctctaagagtg

SEQ ID NO: 47203 - DNA, 19 bp, Homo sapiens
tgattgaaacctctaagag

SEQ ID NO: 47204 - DNA, 18 bp, Homo sapiens
tgattgaaacctctaaga

SEQ ID NO: 47205 - DNA, 21 bp, Homo sapiens
caggagagtggcaatcacatg

SEQ ID NO: 47206 - DNA, 25 bp, Homo sapiens
tactcaggagagtggcaatcacatg

SEQ ID NO: 47207 - DNA, 24 bp, Homo sapiens
tactcaggagagtggcaatcacat

SEQ ID NO: 47208 - DNA, 22 bp, Homo sapiens
actcaggagagtggcaatcaca

SEQ ID NO: 47209 - DNA, 23 bp, Homo sapiens
tactcaggagagtggcaatcaca

SEQ ID NO: 47210 - DNA, 21 bp, Homo sapiens
tactcaggagagtggcaatca

SEQ ID NO: 47211 - DNA, 18 bp, Homo sapiens
tactcaggagagtggcaa

SEQ ID NO: 47212 - DNA, 19 bp, Homo sapiens
tagtcccttccttgaagcg

SEQ ID NO: 47213 - DNA, 20 bp, Homo sapiens
tagtcccttccttgaagcgg

SEQ ID NO: 47214 - DNA, 21 bp, Homo sapiens
tagtcccttccttgaagcggt

SEQ ID NO: 47215 - DNA, 23 bp, Homo sapiens
tagtcccttccttgaagcggtcg

SEQ ID NO: 47216 - DNA, 17 bp, Homo sapiens
agtcccttccttgaagc

SEQ ID NO: 47217 - DNA, 20 bp, Homo sapiens
agtcccttccttgaagcggt

SEQ ID NO: 47218 - DNA, 21 bp, Homo sapiens
agtcccttccttgaagcggtc

SEQ ID NO: 47219 - DNA, 22 bp, Homo sapiens
agtcccttccttgaagcggtcg

SEQ ID NO: 47220 - DNA, 16 bp, Homo sapiens
tcccttccttgaagcg

SEQ ID NO: 47221 - DNA, 17 bp, Homo sapiens
tcccttccttgaagcgg

SEQ ID NO: 47222 - DNA, 19 bp, Homo sapiens
tcccttccttgaagcggtc

SEQ ID NO: 47223 - DNA, 22 bp, Homo sapiens
tcccttccttgaagcggtcgga

SEQ ID NO: 47224 - DNA, 24 bp, Homo sapiens
tcccttccttgaagcggtcggata

SEQ ID NO: 47225 - DNA, 19 bp, Homo sapiens
acatgacgagcctcaagca

SEQ ID NO: 47226 - DNA, 19 bp, Homo sapiens
acgagcctcaagcaaggga

SEQ ID NO: 47227 - DNA, 20 bp, Homo sapiens
acgagcctcaagcaagggac

SEQ ID NO: 47228 - DNA, 22 bp, Homo sapiens
acgagcctcaagcaagggactt

SEQ ID NO: 47229 - DNA, 23 bp, Homo sapiens
acgagcctcaagcaagggacttc

SEQ ID NO: 47230 - DNA, 24 bp, Homo sapiens
acgagcctcaagcaagggacttca

SEQ ID NO: 47231 - DNA, 16 bp, Homo sapiens
cgagcctcaagcaagg

SEQ ID NO: 47232 - DNA, 19 bp, Homo sapiens
cgagcctcaagcaagggac

SEQ ID NO: 47233 - DNA, 20 bp, Homo sapiens
cgagcctcaagcaagggact

SEQ ID NO: 47234 - DNA, 22 bp, Homo sapiens
cgagcctcaagcaagggacttc

SEQ ID NO: 47235 - DNA, 23 bp, Homo sapiens
cgagcctcaagcaagggacttca

SEQ ID NO: 47236 - DNA, 24 bp, Homo sapiens
cgagcctcaagcaagggacttcaa

SEQ ID NO: 47237 - DNA, 25 bp, Homo sapiens
cgagcctcaagcaagggacttcaag

SEQ ID NO: 47238 - DNA, 26 bp, Homo sapiens
cgagcctcaagcaagggacttcaagc

SEQ ID NO: 47239 - DNA, 18 bp, Homo sapiens
agcctcaagcaagggact

SEQ ID NO: 47240 - DNA, 18 bp, Homo sapiens
ctgctcctcagatcagag

SEQ ID NO: 47241 - DNA, 19 bp, Homo sapiens
ctgctcctcagatcagagc

SEQ ID NO: 47242 - DNA, 20 bp, Homo sapiens
ctgctcctcagatcagagcc

SEQ ID NO: 47243 - DNA, 21 bp, Homo sapiens
ctgctcctcagatcagagcct

SEQ ID NO: 47244 - DNA, 23 bp, Homo sapiens
ctgctcctcagatcagagccttg

SEQ ID NO: 47245 - DNA, 24 bp, Homo sapiens
ctgctcctcagatcagagccttgc

SEQ ID NO: 47246 - DNA, 25 bp, Homo sapiens
aatggtgccctagtgactacaaagc

SEQ ID NO: 47247 - DNA, 26 bp, Homo sapiens
aaatggtgccctagtgactacaaagc

SEQ ID NO: 47248 - DNA, 24 bp, Homo sapiens
aaatggtgccctagtgactacaaa

SEQ ID NO: 47249 - DNA, 21 bp, Homo sapiens
atggtgccctagtgactacaa

SEQ ID NO: 47250 - DNA, 22 bp, Homo sapiens
aatggtgccctagtgactacaa

SEQ ID NO: 47251 - DNA, 23 bp, Homo sapiens
aaatggtgccctagtgactacaa

SEQ ID NO: 47252 - DNA, 21 bp, Homo sapiens
aatggtgccctagtgactaca

SEQ ID NO: 47253 - DNA, 22 bp, Homo sapiens
aaatggtgccctagtgactaca

SEQ ID NO: 47254 - DNA, 21 bp, Homo sapiens
aaatggtgccctagtgactac

SEQ ID NO: 47255 - DNA, 22 bp, Homo sapiens
aaaatggtgccctagtgactac

SEQ ID NO: 47256 - DNA, 19 bp, Homo sapiens
aatggtgccctagtgacta

SEQ ID NO: 47257 - DNA, 20 bp, Homo sapiens
aaatggtgccctagtgacta

SEQ ID NO: 47258 - DNA, 21 bp, Homo sapiens
aaaatggtgccctagtgacta

SEQ ID NO: 47259 - DNA, 19 bp, Homo sapiens
aaatggtgccctagtgact

SEQ ID NO: 47260 - DNA, 20 bp, Homo sapiens
aaaatggtgccctagtgact

SEQ ID NO: 47261 - DNA, 26 bp, Homo sapiens
caagtcactagtggttccgtttagta

SEQ ID NO: 47262 - DNA, 25 bp, Homo sapiens
caagtcactagtggttccgtttagt

SEQ ID NO: 47263 - DNA, 24 bp, Homo sapiens
caagtcactagtggttccgtttag

SEQ ID NO: 47264 - DNA, 23 bp, Homo sapiens
caagtcactagtggttccgttta

SEQ ID NO: 47265 - DNA, 22 bp, Homo sapiens
caagtcactagtggttccgttt

SEQ ID NO: 47266 - DNA, 19 bp, Homo sapiens
caagtcactagtggttccg

SEQ ID NO: 47267 - DNA, 17 bp, Homo sapiens
caagtcactagtggttc

SEQ ID NO: 47268 - DNA, 23 bp, Homo sapiens
agtctcatctgcaaagaagtaag

SEQ ID NO: 47269 - DNA, 25 bp, Homo sapiens
tcagtctcatctgcaaagaagtaag

SEQ ID NO: 47270 - DNA, 24 bp, Homo sapiens
tcagtctcatctgcaaagaagtaa

SEQ ID NO: 47271 - DNA, 23 bp, Homo sapiens
tcagtctcatctgcaaagaagta

SEQ ID NO: 47272 - DNA, 24 bp, Homo sapiens
ctcagtctcatctgcaaagaagta

SEQ ID NO: 47273 - DNA, 21 bp, Homo sapiens
cagtctcatctgcaaagaagt

SEQ ID NO: 47274 - DNA, 22 bp, Homo sapiens
tcagtctcatctgcaaagaagt

SEQ ID NO: 47275 - DNA, 23 bp, Homo sapiens
ctcagtctcatctgcaaagaagt

SEQ ID NO: 47276 - DNA, 21 bp, Homo sapiens
tcagtctcatctgcaaagaag

SEQ ID NO: 47277 - DNA, 22 bp, Homo sapiens
ctcagtctcatctgcaaagaag

SEQ ID NO: 47278 - DNA, 20 bp, Homo sapiens
tcagtctcatctgcaaagaa

SEQ ID NO: 47279 - DNA, 21 bp, Homo sapiens
ctcagtctcatctgcaaagaa

SEQ ID NO: 47280 - DNA, 20 bp, Homo sapiens
ctcagtctcatctgcaaaga

SEQ ID NO: 47281 - DNA, 25 bp, Homo sapiens
tgtttgcagaggaaactgagacttt

SEQ ID NO: 47282 - DNA, 24 bp, Homo sapiens
tgtttgcagaggaaactgagactt

SEQ ID NO: 47283 - DNA, 21 bp, Homo sapiens
tttgcagaggaaactgagact

SEQ ID NO: 47284 - DNA, 22 bp, Homo sapiens
tgtttgcagaggaaactgagac

SEQ ID NO: 47285 - DNA, 25 bp, Homo sapiens
aactgtttgcagaggaaactgagac

SEQ ID NO: 47286 - DNA, 21 bp, Homo sapiens
tgtttgcagaggaaactgaga

SEQ ID NO: 47287 - DNA, 24 bp, Homo sapiens
aactgtttgcagaggaaactgaga

SEQ ID NO: 47288 - DNA, 20 bp, Homo sapiens
tgtttgcagaggaaactgag

SEQ ID NO: 47289 - DNA, 23 bp, Homo sapiens
aactgtttgcagaggaaactgag

SEQ ID NO: 47290 - DNA, 21 bp, Homo sapiens
aactgtttgcagaggaaactg

SEQ ID NO: 47291 - DNA, 20 bp, Homo sapiens
aactgtttgcagaggaaact

SEQ ID NO: 47292 - DNA, 19 bp, Homo sapiens
aactgtttgcagaggaaac

SEQ ID NO: 47293 - DNA, 18 bp, Homo sapiens
aactgtttgcagaggaaa

SEQ ID NO: 47294 - DNA, 16 bp, Homo sapiens
gagcatgtgctacggt

SEQ ID NO: 47295 - DNA, 22 bp, Homo sapiens
tgctcataccccatggtttctg

SEQ ID NO: 47296 - DNA, 23 bp, Homo sapiens
ctgctcataccccatggtttctg

SEQ ID NO: 47297 - DNA, 21 bp, Homo sapiens
tgctcataccccatggtttct

SEQ ID NO: 47298 - DNA, 22 bp, Homo sapiens
ctgctcataccccatggtttct

SEQ ID NO: 47299 - DNA, 21 bp, Homo sapiens
ctgctcataccccatggtttc

SEQ ID NO: 47300 - DNA, 22 bp, Homo sapiens
tctgctcataccccatggtttc

SEQ ID NO: 47301 - DNA, 20 bp, Homo sapiens
ctgctcataccccatggttt

SEQ ID NO: 47302 - DNA, 21 bp, Homo sapiens
tctgctcataccccatggttt

SEQ ID NO: 47303 - DNA, 20 bp, Homo sapiens
tctgctcataccccatggtt

SEQ ID NO: 47304 - DNA, 18 bp, Homo sapiens
tctgctcataccccatgg

SEQ ID NO: 47305 - DNA, 16 bp, Homo sapiens
ctgctcataccccatg

SEQ ID NO: 47306 - DNA, 17 bp, Homo sapiens
gtctgagcatgcagcat

SEQ ID NO: 47307 - DNA, 27 bp, Homo sapiens
tgcaccatggttgtctgagcatgcagc

SEQ ID NO: 47308 - DNA, 25 bp, Homo sapiens
tgcaccatggttgtctgagcatgca

SEQ ID NO: 47309 - DNA, 24 bp, Homo sapiens
tgcaccatggttgtctgagcatgc

SEQ ID NO: 47310 - DNA, 22 bp, Homo sapiens
tgcaccatggttgtctgagcat

SEQ ID NO: 47311 - DNA, 21 bp, Homo sapiens
tgcaccatggttgtctgagca

SEQ ID NO: 47312 - DNA, 20 bp, Homo sapiens
tgcaccatggttgtctgagc

SEQ ID NO: 47313 - DNA, 19 bp, Homo sapiens
tgcaccatggttgtctgag

SEQ ID NO: 47314 - DNA, 17 bp, Homo sapiens
tgcaccatggttgtctg

SEQ ID NO: 47315 - DNA, 20 bp, Homo sapiens
tgctcatgcaccatggttgt

SEQ ID NO: 47316 - DNA, 28 bp, Homo sapiens
ccacggatgtttgagcatgtgctatggt

SEQ ID NO: 47317 - DNA, 23 bp, Homo sapiens
acggatgtttgagcatgtgctat

SEQ ID NO: 47318 - DNA, 24 bp, Homo sapiens
tggaagggagaagagctttaatga

SEQ ID NO: 47319 - DNA, 22 bp, Homo sapiens
gaagggagaagagctttaatga

SEQ ID NO: 47320 - DNA, 23 bp, Homo sapiens
gaagggagaagagctttaatgat

SEQ ID NO: 47321 - DNA, 21 bp, Homo sapiens
aagggagaagagctttaatga

SEQ ID NO: 47322 - DNA, 22 bp, Homo sapiens
aagggagaagagctttaatgat

SEQ ID NO: 47323 - DNA, 23 bp, Homo sapiens
aagggagaagagctttaatgatt

SEQ ID NO: 47324 - DNA, 20 bp, Homo sapiens
agggagaagagctttaatga

SEQ ID NO: 47325 - DNA, 21 bp, Homo sapiens
agggagaagagctttaatgat

SEQ ID NO: 47326 - DNA, 23 bp, Homo sapiens
aagggagaagagctttaatgctc

SEQ ID NO: 47327 - DNA, 21 bp, Homo sapiens
agggagaagagctttaatgct

SEQ ID NO: 47328 - DNA, 22 bp, Homo sapiens
aagggagaagagctttaatgct

SEQ ID NO: 47329 - DNA, 20 bp, Homo sapiens
agggagaagagctttaatgc

SEQ ID NO: 47330 - DNA, 21 bp, Homo sapiens
aagggagaagagctttaatgc

SEQ ID NO: 47331 - DNA, 22 bp, Homo sapiens
gaagggagaagagctttaatgc

SEQ ID NO: 47332 - DNA, 24 bp, Homo sapiens
ccgccccttccgccccgccgggcg

SEQ ID NO: 47333 - DNA, 16 bp, Homo sapiens
ttccgccccgccgggc

SEQ ID NO: 47334 - DNA, 18 bp, Homo sapiens
ccgccccttccgccccgc

SEQ ID NO: 47335 - DNA, 18 bp, Homo sapiens
gtgaggaggggctggcag

SEQ ID NO: 47336 - DNA, 19 bp, Homo sapiens
gtgaggaggggctggcagg

SEQ ID NO: 47337 - DNA, 20 bp, Homo sapiens
gtgaggaggggctggcaggg

SEQ ID NO: 47338 - DNA, 21 bp, Homo sapiens
gtgaggaggggctggcaggga

SEQ ID NO: 47339 - DNA, 23 bp, Homo sapiens
gtgaggaggggctggcagggacc

SEQ ID NO: 47340 - DNA, 24 bp, Homo sapiens
gtgaggaggggctggcagggaccc

SEQ ID NO: 47341 - DNA, 25 bp, Homo sapiens
gtgaggaggggctggcagggacccc

SEQ ID NO: 47342 - DNA, 19 bp, Homo sapiens
tgaggaggggctggcaggg

SEQ ID NO: 47343 - DNA, 20 bp, Homo sapiens
tgaggaggggctggcaggga

SEQ ID NO: 47344 - DNA, 21 bp, Homo sapiens
tgaggaggggctggcagggac

SEQ ID NO: 47345 - DNA, 22 bp, Homo sapiens
tgaggaggggctggcagggacc

SEQ ID NO: 47346 - DNA, 26 bp, Homo sapiens
tgaggaggggctggcagggacccctc

SEQ ID NO: 47347 - DNA, 27 bp, Homo sapiens
tgaggaggggctggcagggacccctcc

SEQ ID NO: 47348 - DNA, 20 bp, Homo sapiens
aggaggggctggcagggacc

SEQ ID NO: 47349 - DNA, 21 bp, Homo sapiens
aggaggggctggcagggaccc

SEQ ID NO: 47350 - DNA, 22 bp, Homo sapiens
aggaggggctggcagggacccc

SEQ ID NO: 47351 - DNA, 16 bp, Homo sapiens
tggcagggacccctcc

SEQ ID NO: 47352 - DNA, 16 bp, Homo sapiens
ggacggcagccagccc

SEQ ID NO: 47353 - DNA, 17 bp, Homo sapiens
ggacggcagccagcccc

SEQ ID NO: 47354 - DNA, 18 bp, Homo sapiens
ggacggcagccagcccct

SEQ ID NO: 47355 - DNA, 19 bp, Homo sapiens
ggacggcagccagcccctg

SEQ ID NO: 47356 - DNA, 25 bp, Homo sapiens
ggacggcagccagcccctgctcacc

SEQ ID NO: 47357 - DNA, 28 bp, Homo sapiens
ggacggcagccagcccctgctcacccct

SEQ ID NO: 47358 - DNA, 17 bp, Homo sapiens
acggcagccagcccctg

SEQ ID NO: 47359 - DNA, 23 bp, Homo sapiens
acggcagccagcccctgctcacc

SEQ ID NO: 47360 - DNA, 24 bp, Homo sapiens
acggcagccagcccctgctcaccc

SEQ ID NO: 47361 - DNA, 23 bp, Homo sapiens
cggcagccagcccctgctcaccc

SEQ ID NO: 47362 - DNA, 23 bp, Homo sapiens
ggcagccagcccctgctcacccc

SEQ ID NO: 47363 - DNA, 24 bp, Homo sapiens
ggcagccagcccctgctcacccct

SEQ ID NO: 47364 - DNA, 22 bp, Homo sapiens
gcagccagcccctgctcacccc

SEQ ID NO: 47365 - DNA, 18 bp, Homo sapiens
cagccagcccctgctcac

SEQ ID NO: 47366 - DNA, 19 bp, Homo sapiens
cagccagcccctgctcacc

SEQ ID NO: 47367 - DNA, 20 bp, Homo sapiens
cagccagcccctgctcaccc

SEQ ID NO: 47368 - DNA, 21 bp, Homo sapiens
cagccagcccctgctcacccc

SEQ ID NO: 47369 - DNA, 23 bp, Homo sapiens
cagccagcccctgctcacccctc

SEQ ID NO: 47370 - DNA, 24 bp, Homo sapiens
cagccagcccctgctcacccctcg

SEQ ID NO: 47371 - DNA, 22 bp, Homo sapiens
agccagcccctgctcacccctc

SEQ ID NO: 47372 - DNA, 16 bp, Homo sapiens
ttaaaatgggctaagg

SEQ ID NO: 47373 - DNA, 17 bp, Homo sapiens
ttaaaatgggctaaggg

SEQ ID NO: 47374 - DNA, 18 bp, Homo sapiens
ttaaaatgggctaaggga

SEQ ID NO: 47375 - DNA, 19 bp, Homo sapiens
ttaaaatgggctaagggag

SEQ ID NO: 47376 - DNA, 20 bp, Homo sapiens
ttaaaatgggctaagggaga

SEQ ID NO: 47377 - DNA, 22 bp, Homo sapiens
ttaaaatgggctaagggagatg

SEQ ID NO: 47378 - DNA, 23 bp, Homo sapiens
ttaaaatgggctaagggagatga

SEQ ID NO: 47379 - DNA, 24 bp, Homo sapiens
ttaaaatgggctaagggagatgat

SEQ ID NO: 47380 - DNA, 25 bp, Homo sapiens
ttaaaatgggctaagggagatgatt

SEQ ID NO: 47381 - DNA, 24 bp, Homo sapiens
taaaatgggctaagggagatgatt

SEQ ID NO: 47382 - DNA, 21 bp, Homo sapiens
aatgggctaagggagatgatt

SEQ ID NO: 47383 - DNA, 20 bp, Homo sapiens
atgggctaagggagatgatt

SEQ ID NO: 47384 - DNA, 21 bp, Homo sapiens
atgggctaagggagatgattg

SEQ ID NO: 47385 - DNA, 22 bp, Homo sapiens
atgggctaagggagatgattgg

SEQ ID NO: 47386 - DNA, 24 bp, Homo sapiens
atgggctaagggagatgattgggt

SEQ ID NO: 47387 - DNA, 26 bp, Homo sapiens
atgggctaagggagatgattgggtag

SEQ ID NO: 47388 - DNA, 19 bp, Homo sapiens
tgggctaagggagatgatt

SEQ ID NO: 47389 - DNA, 21 bp, Homo sapiens
tgggctaagggagatgattgg

SEQ ID NO: 47390 - DNA, 22 bp, Homo sapiens
tgggctaagggagatgattggg

SEQ ID NO: 47391 - DNA, 23 bp, Homo sapiens
tgggctaagggagatgattgggt

SEQ ID NO: 47392 - DNA, 25 bp, Homo sapiens
tgggctaagggagatgattgggtag

SEQ ID NO: 47393 - DNA, 26 bp, Homo sapiens
tgggctaagggagatgattgggtaga

SEQ ID NO: 47394 - DNA, 24 bp, Homo sapiens
gggctaagggagatgattgggtag

SEQ ID NO: 47395 - DNA, 28 bp, Homo sapiens
gggctaagggagatgattgggtagaaag

SEQ ID NO: 47396 - DNA, 28 bp, Homo sapiens
ggctaagggagatgattgggtagaaagt

SEQ ID NO: 47397 - DNA, 19 bp, Homo sapiens
taagggagatgattgggta

SEQ ID NO: 47398 - DNA, 21 bp, Homo sapiens
taagggagatgattgggtaga

SEQ ID NO: 47399 - DNA, 22 bp, Homo sapiens
taagggagatgattgggtagaa

SEQ ID NO: 47400 - DNA, 23 bp, Homo sapiens
taagggagatgattgggtagaaa

SEQ ID NO: 47401 - DNA, 22 bp, Homo sapiens
agggagatgattgggtagaaag

SEQ ID NO: 47402 - DNA, 23 bp, Homo sapiens
agggagatgattgggtagaaagt

SEQ ID NO: 47403 - DNA, 22 bp, Homo sapiens
gggagatgattgggtagaaagt

SEQ ID NO: 47404 - DNA, 18 bp, Homo sapiens
attctattcatttgcctc

SEQ ID NO: 47405 - DNA, 22 bp, Homo sapiens
attctattcatttgcctcccag

SEQ ID NO: 47406 - DNA, 23 bp, Homo sapiens
attctattcatttgcctcccagc

SEQ ID NO: 47407 - DNA, 25 bp, Homo sapiens
attctattcatttgcctcccagcct

SEQ ID NO: 47408 - DNA, 28 bp, Homo sapiens
attctattcatttgcctcccagcctaca

SEQ ID NO: 47409 - DNA, 22 bp, Homo sapiens
ttctattcatttgcctcccagc

SEQ ID NO: 47410 - DNA, 26 bp, Homo sapiens
tctattcatttgcctcccagcctaca

SEQ ID NO: 47411 - DNA, 28 bp, Homo sapiens
tctattcatttgcctcccagcctacaaa

SEQ ID NO: 47412 - DNA, 17 bp, Homo sapiens
ctattcatttgcctccc

SEQ ID NO: 47413 - DNA, 21 bp, Homo sapiens
ctattcatttgcctcccagcc

SEQ ID NO: 47414 - DNA, 22 bp, Homo sapiens
ctattcatttgcctcccagcct

SEQ ID NO: 47415 - DNA, 25 bp, Homo sapiens
ctattcatttgcctcccagcctaca

SEQ ID NO: 47416 - DNA, 26 bp, Homo sapiens
ctattcatttgcctcccagcctacaa

SEQ ID NO: 47417 - DNA, 27 bp, Homo sapiens
ctattcatttgcctcccagcctacaaa

SEQ ID NO: 47418 - DNA, 28 bp, Homo sapiens
ctattcatttgcctcccagcctacaaaa

SEQ ID NO: 47419 - DNA, 21 bp, Homo sapiens
tcatttgcctcccagcctaca

SEQ ID NO: 47420 - DNA, 22 bp, Homo sapiens
tcatttgcctcccagcctacaa

SEQ ID NO: 47421 - DNA, 28 bp, Homo sapiens
tggcaaaaactgcagttacttttgtacc

SEQ ID NO: 47422 - DNA, 27 bp, Homo sapiens
aaagtaattgcggtttttgccgtcgaa

SEQ ID NO: 47423 - DNA, 24 bp, Homo sapiens
aaagtaattgcggtttttgccgtc

SEQ ID NO: 47424 - DNA, 23 bp, Homo sapiens
attctctctggatcccatggata

SEQ ID NO: 47425 - DNA, 25 bp, Homo sapiens
attctctctggatcccatggatatg

SEQ ID NO: 47426 - DNA, 22 bp, Homo sapiens
ttctctctggatcccatggata

SEQ ID NO: 47427 - DNA, 24 bp, Homo sapiens
ttctctctggatcccatggatatg

SEQ ID NO: 47428 - DNA, 22 bp, Homo sapiens
gtccaggagatccagagagaat

SEQ ID NO: 47429 - DNA, 20 bp, Homo sapiens
tccaggagatccagagagaa

SEQ ID NO: 47430 - DNA, 21 bp, Homo sapiens
tccaggagatccagagagaat

SEQ ID NO: 47431 - DNA, 22 bp, Homo sapiens
tccaggagatccagagagaatc

SEQ ID NO: 47432 - DNA, 23 bp, Homo sapiens
tccaggagatccagagagaatca

SEQ ID NO: 47433 - DNA, 22 bp, Homo sapiens
ccaggagatccagagagaatca

SEQ ID NO: 47434 - DNA, 27 bp, Homo sapiens
atcacattgccagtgattacccaagga

SEQ ID NO: 47435 - DNA, 25 bp, Homo sapiens
atcacattgccagtgattacccaag

SEQ ID NO: 47436 - DNA, 24 bp, Homo sapiens
atcacattgccagtgattacccaa

SEQ ID NO: 47437 - DNA, 23 bp, Homo sapiens
atcacattgccagtgattaccca

SEQ ID NO: 47438 - DNA, 21 bp, Homo sapiens
atcacattgccagtgattacc

SEQ ID NO: 47439 - DNA, 20 bp, Homo sapiens
atcacattgccagtgattac

SEQ ID NO: 47440 - DNA, 19 bp, Homo sapiens
atcacattgccagtgatta

SEQ ID NO: 47441 - DNA, 18 bp, Homo sapiens
atcacattgccagtgatt

SEQ ID NO: 47442 - DNA, 17 bp, Homo sapiens
atcacattgccagtgat

SEQ ID NO: 47443 - DNA, 20 bp, Homo sapiens
gccagtggaggccggggtgg

SEQ ID NO: 47444 - DNA, 23 bp, Homo sapiens
tgaggtggtaggatgtagagctg

SEQ ID NO: 47445 - DNA, 22 bp, Homo sapiens
tgaggtggtaggatgtagagct

SEQ ID NO: 47446 - DNA, 21 bp, Homo sapiens
tgaggtggtaggatgtagagc

SEQ ID NO: 47447 - DNA, 20 bp, Homo sapiens
tgaggtggtaggatgtagag

SEQ ID NO: 47448 - DNA, 23 bp, Homo sapiens
gcatgtcagattgtaattcccag

SEQ ID NO: 47449 - DNA, 25 bp, Homo sapiens
atgtcagattgtaattcccaggccc

SEQ ID NO: 47450 - DNA, 21 bp, Homo sapiens
tgtcagattgtaattcccagg

SEQ ID NO: 47451 - DNA, 23 bp, Homo sapiens
tgtcagattgtaattcccaggcc

SEQ ID NO: 47452 - DNA, 22 bp, Homo sapiens
attgaggaaaagatggtcttat

SEQ ID NO: 47453 - DNA, 21 bp, Homo sapiens
caacaggcggctgtagcaatg

SEQ ID NO: 47454 - DNA, 21 bp, Homo sapiens
acaggcggctgtagcaatggg

SEQ ID NO: 47455 - DNA, 22 bp, Homo sapiens
acaggcggctgtagcaatgggg

SEQ ID NO: 47456 - DNA, 22 bp, Homo sapiens
ttgggctgggctgggttgggca

SEQ ID NO: 47457 - DNA, 24 bp, Homo sapiens
agctacattgtctgctgggtttca

SEQ ID NO: 47458 - DNA, 22 bp, Homo sapiens
agctacattgtctgctgggttt

SEQ ID NO: 47459 - DNA, 21 bp, Homo sapiens
agctacattgtctgctgggtt

SEQ ID NO: 47460 - DNA, 20 bp, Homo sapiens
agctacattgtctgctgggt

SEQ ID NO: 47461 - DNA, 19 bp, Homo sapiens
agctacattgtctgctggg

SEQ ID NO: 47462 - DNA, 18 bp, Homo sapiens
agctacattgtctgctgg

SEQ ID NO: 47463 - DNA, 27 bp, Homo sapiens
acctggcatacaatgtagatttctgtg

SEQ ID NO: 47464 - DNA, 26 bp, Homo sapiens
acctggcatacaatgtagatttctgt

SEQ ID NO: 47465 - DNA, 25 bp, Homo sapiens
acctggcatacaatgtagatttctg

SEQ ID NO: 47466 - DNA, 24 bp, Homo sapiens
acctggcatacaatgtagatttct

SEQ ID NO: 47467 - DNA, 23 bp, Homo sapiens
acctggcatacaatgtagatttc

SEQ ID NO: 47468 - DNA, 21 bp, Homo sapiens
cctggcatacaatgtagattt

SEQ ID NO: 47469 - DNA, 21 bp, Homo sapiens
acctggcatacaatgtagatt

SEQ ID NO: 47470 - DNA, 22 bp, Homo sapiens
aacctggcatacaatgtagatt

SEQ ID NO: 47471 - DNA, 20 bp, Homo sapiens
acctggcatacaatgtagat

SEQ ID NO: 47472 - DNA, 19 bp, Homo sapiens
acctggcatacaatgtaga

SEQ ID NO: 47473 - DNA, 27 bp, Homo sapiens
agctacatctggctactgggtctctga

SEQ ID NO: 47474 - DNA, 25 bp, Homo sapiens
agctacatctggctactgggtctct

SEQ ID NO: 47475 - DNA, 24 bp, Homo sapiens
agctacatctggctactgggtctc

SEQ ID NO: 47476 - DNA, 23 bp, Homo sapiens
agctacatctggctactgggtct

SEQ ID NO: 47477 - DNA, 22 bp, Homo sapiens
agctacatctggctactgggtc

SEQ ID NO: 47478 - DNA, 20 bp, Homo sapiens
agctacatctggctactggg

SEQ ID NO: 47479 - DNA, 19 bp, Homo sapiens
agctacatctggctactgg

SEQ ID NO: 47480 - DNA, 25 bp, Homo sapiens
tcagtagccagtgtagatcctgtct

SEQ ID NO: 47481 - DNA, 28 bp, Homo sapiens
ggctcagtagccagtgtagatcctgtct

SEQ ID NO: 47482 - DNA, 25 bp, Homo sapiens
ctcagtagccagtgtagatcctgtc

SEQ ID NO: 47483 - DNA, 27 bp, Homo sapiens
ggctcagtagccagtgtagatcctgtc

SEQ ID NO: 47484 - DNA, 23 bp, Homo sapiens
tcagtagccagtgtagatcctgt

SEQ ID NO: 47485 - DNA, 26 bp, Homo sapiens
ggctcagtagccagtgtagatcctgt

SEQ ID NO: 47486 - DNA, 22 bp, Homo sapiens
tcagtagccagtgtagatcctg

SEQ ID NO: 47487 - DNA, 21 bp, Homo sapiens
tcagtagccagtgtagatcct

SEQ ID NO: 47488 - DNA, 24 bp, Homo sapiens
ggctcagtagccagtgtagatcct

SEQ ID NO: 47489 - DNA, 21 bp, Homo sapiens
ctcagtagccagtgtagatcc

SEQ ID NO: 47490 - DNA, 23 bp, Homo sapiens
ggctcagtagccagtgtagatcc

SEQ ID NO: 47491 - DNA, 20 bp, Homo sapiens
ctcagtagccagtgtagatc

SEQ ID NO: 47492 - DNA, 22 bp, Homo sapiens
ggctcagtagccagtgtagatc

SEQ ID NO: 47493 - DNA, 21 bp, Homo sapiens
ggctcagtagccagtgtagat

SEQ ID NO: 47494 - DNA, 20 bp, Homo sapiens
ggctcagtagccagtgtaga

SEQ ID NO: 47495 - DNA, 18 bp, Homo sapiens
ggctcagtagccagtgta

SEQ ID NO: 47496 - DNA, 20 bp, Homo sapiens
ggtgggatggagagaaggta

SEQ ID NO: 47497 - DNA, 21 bp, Homo sapiens
ggtgggatggagagaaggtat

SEQ ID NO: 47498 - DNA, 23 bp, Homo sapiens
ggtgggatggagagaaggtatga

SEQ ID NO: 47499 - DNA, 26 bp, Homo sapiens
ggtgggatggagagaaggtatgagct

SEQ ID NO: 47500 - DNA, 21 bp, Homo sapiens
gtgggatggagagaaggtatg

SEQ ID NO: 47501 - DNA, 22 bp, Homo sapiens
gtgggatggagagaaggtatga

SEQ ID NO: 47502 - DNA, 23 bp, Homo sapiens
gtgggatggagagaaggtatgag

SEQ ID NO: 47503 - DNA, 24 bp, Homo sapiens
gtgggatggagagaaggtatgagc

SEQ ID NO: 47504 - DNA, 25 bp, Homo sapiens
gtgggatggagagaaggtatgagct

SEQ ID NO: 47505 - DNA, 21 bp, Homo sapiens
tgggatggagagaaggtatga

SEQ ID NO: 47506 - DNA, 23 bp, Homo sapiens
tgggatggagagaaggtatgagc

SEQ ID NO: 47507 - DNA, 24 bp, Homo sapiens
tgggatggagagaaggtatgagct

SEQ ID NO: 47508 - DNA, 19 bp, Homo sapiens
ccaagctctgccatcctcc

SEQ ID NO: 47509 - DNA, 20 bp, Homo sapiens
tctgccatcctccctcccct

SEQ ID NO: 47510 - DNA, 21 bp, Homo sapiens
tctgccatcctccctccccta

SEQ ID NO: 47511 - DNA, 23 bp, Homo sapiens
tctgccatcctccctcccctact

SEQ ID NO: 47512 - DNA, 24 bp, Homo sapiens
tctgccatcctccctcccctactt

SEQ ID NO: 47513 - DNA, 25 bp, Homo sapiens
tctgccatcctccctcccctacttc

SEQ ID NO: 47514 - DNA, 18 bp, Homo sapiens
catgccttgagtgtagga

SEQ ID NO: 47515 - DNA, 19 bp, Homo sapiens
catgccttgagtgtaggac

SEQ ID NO: 47516 - DNA, 20 bp, Homo sapiens
catgccttgagtgtaggacc

SEQ ID NO: 47517 - DNA, 21 bp, Homo sapiens
catgccttgagtgtaggaccg

SEQ ID NO: 47518 - DNA, 23 bp, Homo sapiens
catgccttgagtgtaggaccgtt

SEQ ID NO: 47519 - DNA, 24 bp, Homo sapiens
catgccttgagtgtaggaccgttg

SEQ ID NO: 47520 - DNA, 21 bp, Homo sapiens
atgccttgagtgtaggaccgt

SEQ ID NO: 47521 - DNA, 17 bp, Homo sapiens
cctcccacacccaaggc

SEQ ID NO: 47522 - DNA, 18 bp, Homo sapiens
cctcccacacccaaggct

SEQ ID NO: 47523 - DNA, 19 bp, Homo sapiens
cctcccacacccaaggctt

SEQ ID NO: 47524 - DNA, 20 bp, Homo sapiens
cctcccacacccaaggcttg

SEQ ID NO: 47525 - DNA, 21 bp, Homo sapiens
cctcccacacccaaggcttgc

SEQ ID NO: 47526 - DNA, 23 bp, Homo sapiens
cctcccacacccaaggcttgcaa

SEQ ID NO: 47527 - DNA, 24 bp, Homo sapiens
cctcccacacccaaggcttgcaaa

SEQ ID NO: 47528 - DNA, 16 bp, Homo sapiens
catcccttgcatggtg

SEQ ID NO: 47529 - DNA, 18 bp, Homo sapiens
catcccttgcatggtgga

SEQ ID NO: 47530 - DNA, 19 bp, Homo sapiens
catcccttgcatggtggag

SEQ ID NO: 47531 - DNA, 20 bp, Homo sapiens
catcccttgcatggtggagg

SEQ ID NO: 47532 - DNA, 22 bp, Homo sapiens
catcccttgcatggtggagggt

SEQ ID NO: 47533 - DNA, 23 bp, Homo sapiens
catcccttgcatggtggagggtg

SEQ ID NO: 47534 - DNA, 24 bp, Homo sapiens
catcccttgcatggtggagggtga

SEQ ID NO: 47535 - DNA, 26 bp, Homo sapiens
catcccttgcatggtggagggtgagc

SEQ ID NO: 47536 - DNA, 16 bp, Homo sapiens
atcccttgcatggtgg

SEQ ID NO: 47537 - DNA, 21 bp, Homo sapiens
cctcccacatgcagggtttgc

SEQ ID NO: 47538 - DNA, 22 bp, Homo sapiens
cctcccacatgcagggtttgca

SEQ ID NO: 47539 - DNA, 17 bp, Homo sapiens
ctcccacatgcagggtt

SEQ ID NO: 47540 - DNA, 19 bp, Homo sapiens
ctcccacatgcagggtttg

SEQ ID NO: 47541 - DNA, 20 bp, Homo sapiens
ctcccacatgcagggtttgc

SEQ ID NO: 47542 - DNA, 22 bp, Homo sapiens
ctcccacatgcagggtttgcag

SEQ ID NO: 47543 - DNA, 23 bp, Homo sapiens
ctcccacatgcagggtttgcagg

SEQ ID NO: 47544 - DNA, 25 bp, Homo sapiens
ctcccacatgcagggtttgcaggat

SEQ ID NO: 47545 - DNA, 24 bp, Homo sapiens
cttgctacctgggtgagagtgctg

SEQ ID NO: 47546 - DNA, 22 bp, Homo sapiens
aatgcacctgggcaaggattct

SEQ ID NO: 47547 - DNA, 23 bp, Homo sapiens
aatgcacctgggcaaggattctg

SEQ ID NO: 47548 - DNA, 24 bp, Homo sapiens
aatgcacctgggcaaggattctga

SEQ ID NO: 47549 - DNA, 21 bp, Homo sapiens
atgcacctgggcaaggattct

SEQ ID NO: 47550 - DNA, 23 bp, Homo sapiens
atgcacctgggcaaggattctga

SEQ ID NO: 47551 - DNA, 24 bp, Homo sapiens
atgcacctgggcaaggattctgag

SEQ ID NO: 47552 - DNA, 26 bp, Homo sapiens
atgcacctgggcaaggattctgagag

SEQ ID NO: 47553 - DNA, 27 bp, Homo sapiens
atgcacctgggcaaggattctgagagc

SEQ ID NO: 47554 - DNA, 16 bp, Homo sapiens
aatccttggaacctag

SEQ ID NO: 47555 - DNA, 17 bp, Homo sapiens
aatccttggaacctagg

SEQ ID NO: 47556 - DNA, 19 bp, Homo sapiens
aatccttggaacctaggtg

SEQ ID NO: 47557 - DNA, 20 bp, Homo sapiens
aatccttggaacctaggtgt

SEQ ID NO: 47558 - DNA, 21 bp, Homo sapiens
aatccttggaacctaggtgtg

SEQ ID NO: 47559 - DNA, 22 bp, Homo sapiens
aatccttggaacctaggtgtga

SEQ ID NO: 47560 - DNA, 23 bp, Homo sapiens
aatccttggaacctaggtgtgag

SEQ ID NO: 47561 - DNA, 25 bp, Homo sapiens
aatccttggaacctaggtgtgagtg

SEQ ID NO: 47562 - DNA, 26 bp, Homo sapiens
aatccttggaacctaggtgtgagtgc

SEQ ID NO: 47563 - DNA, 27 bp, Homo sapiens
aatccttggaacctaggtgtgagtgct

SEQ ID NO: 47564 - DNA, 28 bp, Homo sapiens
aatccttggaacctaggtgtgagtgcta

SEQ ID NO: 47565 - DNA, 16 bp, Homo sapiens
aacacacctattcaag

SEQ ID NO: 47566 - DNA, 17 bp, Homo sapiens
aacacacctattcaagg

SEQ ID NO: 47567 - DNA, 19 bp, Homo sapiens
aacacacctattcaaggat

SEQ ID NO: 47568 - DNA, 20 bp, Homo sapiens
aacacacctattcaaggatt

SEQ ID NO: 47569 - DNA, 21 bp, Homo sapiens
aacacacctattcaaggattc

SEQ ID NO: 47570 - DNA, 23 bp, Homo sapiens
aacacacctattcaaggattcaa

SEQ ID NO: 47571 - DNA, 24 bp, Homo sapiens
aacacacctattcaaggattcaaa

SEQ ID NO: 47572 - DNA, 18 bp, Homo sapiens
aatcctttgtccctgggt

SEQ ID NO: 47573 - DNA, 20 bp, Homo sapiens
aatcctttgtccctgggtga

SEQ ID NO: 47574 - DNA, 21 bp, Homo sapiens
aatcctttgtccctgggtgag

SEQ ID NO: 47575 - DNA, 23 bp, Homo sapiens
aatcctttgtccctgggtgagag

SEQ ID NO: 47576 - DNA, 24 bp, Homo sapiens
aatcctttgtccctgggtgagagt

SEQ ID NO: 47577 - DNA, 25 bp, Homo sapiens
aatcctttgtccctgggtgagagtg

SEQ ID NO: 47578 - DNA, 26 bp, Homo sapiens
aatcctttgtccctgggtgagagtgc

SEQ ID NO: 47579 - DNA, 28 bp, Homo sapiens
aatcctttgtccctgggtgagagtgctt

SEQ ID NO: 47580 - DNA, 18 bp, Homo sapiens
atcctttgtccctgggtg

SEQ ID NO: 47581 - DNA, 24 bp, Homo sapiens
atgcaatgcacccgggcaaggatt

SEQ ID NO: 47582 - DNA, 16 bp, Homo sapiens
aatgcacccgggcaag

SEQ ID NO: 47583 - DNA, 17 bp, Homo sapiens
aatgcacccgggcaagg

SEQ ID NO: 47584 - DNA, 18 bp, Homo sapiens
aatgcacccgggcaagga

SEQ ID NO: 47585 - DNA, 19 bp, Homo sapiens
aatgcacccgggcaaggat

SEQ ID NO: 47586 - DNA, 20 bp, Homo sapiens
aatgcacccgggcaaggatt

SEQ ID NO: 47587 - DNA, 21 bp, Homo sapiens
aatgcacccgggcaaggattc

SEQ ID NO: 47588 - DNA, 23 bp, Homo sapiens
aatgcacccgggcaaggattctg

SEQ ID NO: 47589 - DNA, 24 bp, Homo sapiens
aatgcacccgggcaaggattctga

SEQ ID NO: 47590 - DNA, 25 bp, Homo sapiens
aatgcacccgggcaaggattctgag

SEQ ID NO: 47591 - DNA, 18 bp, Homo sapiens
atgcacccgggcaaggat

SEQ ID NO: 47592 - DNA, 24 bp, Homo sapiens
aatccttgctacctgggtgagagt

SEQ ID NO: 47593 - DNA, 16 bp, Homo sapiens
ctacctgggtgagagt

SEQ ID NO: 47594 - DNA, 25 bp, Homo sapiens
tgcagtgcacccaggcaaggattct

SEQ ID NO: 47595 - DNA, 18 bp, Homo sapiens
agtgcacccaggcaagga

SEQ ID NO: 47596 - DNA, 20 bp, Homo sapiens
agtgcacccaggcaaggatt

SEQ ID NO: 47597 - DNA, 21 bp, Homo sapiens
agtgcacccaggcaaggattc

SEQ ID NO: 47598 - DNA, 22 bp, Homo sapiens
agtgcacccaggcaaggattct

SEQ ID NO: 47599 - DNA, 23 bp, Homo sapiens
agtgcacccaggcaaggattctg

SEQ ID NO: 47600 - DNA, 24 bp, Homo sapiens
agtgcacccaggcaaggattctgc

SEQ ID NO: 47601 - DNA, 25 bp, Homo sapiens
agtgcacccaggcaaggattctgca

SEQ ID NO: 47602 - DNA, 21 bp, Homo sapiens
gtgcacccaggcaaggattct

SEQ ID NO: 47603 - DNA, 22 bp, Homo sapiens
gtgcacccaggcaaggattctg

SEQ ID NO: 47604 - DNA, 23 bp, Homo sapiens
gtgcacccaggcaaggattctgc

SEQ ID NO: 47605 - DNA, 24 bp, Homo sapiens
gtgcacccaggcaaggattctgca

SEQ ID NO: 47606 - DNA, 21 bp, Homo sapiens
tgcacccaggcaaggattctg

SEQ ID NO: 47607 - DNA, 22 bp, Homo sapiens
tgcacccaggcaaggattctgc

SEQ ID NO: 47608 - DNA, 16 bp, Homo sapiens
tacccattgcatatcg

SEQ ID NO: 47609 - DNA, 19 bp, Homo sapiens
tacccattgcatatcggag

SEQ ID NO: 47610 - DNA, 20 bp, Homo sapiens
tacccattgcatatcggagt

SEQ ID NO: 47611 - DNA, 21 bp, Homo sapiens
tacccattgcatatcggagtt

SEQ ID NO: 47612 - DNA, 23 bp, Homo sapiens
tacccattgcatatcggagttgt

SEQ ID NO: 47613 - DNA, 24 bp, Homo sapiens
tacccattgcatatcggagttgtg

SEQ ID NO: 47614 - DNA, 28 bp, Homo sapiens
tacccattgcatatcggagttgtgaatt

SEQ ID NO: 47615 - DNA, 21 bp, Homo sapiens
acccattgcatatcggagttg

SEQ ID NO: 47616 - DNA, 22 bp, Homo sapiens
acccattgcatatcggagttgt

SEQ ID NO: 47617 - DNA, 18 bp, Homo sapiens
acctcctgtgtgcatgga

SEQ ID NO: 47618 - DNA, 19 bp, Homo sapiens
acctcctgtgtgcatggat

SEQ ID NO: 47619 - DNA, 20 bp, Homo sapiens
acctcctgtgtgcatggatt

SEQ ID NO: 47620 - DNA, 22 bp, Homo sapiens
acctcctgtgtgcatggattac

SEQ ID NO: 47621 - DNA, 23 bp, Homo sapiens
acctcctgtgtgcatggattaca

SEQ ID NO: 47622 - DNA, 20 bp, Homo sapiens
taatccttgctatctgggtg

SEQ ID NO: 47623 - DNA, 21 bp, Homo sapiens
taatccttgctatctgggtgc

SEQ ID NO: 47624 - DNA, 22 bp, Homo sapiens
taatccttgctatctgggtgct

SEQ ID NO: 47625 - DNA, 24 bp, Homo sapiens
taatccttgctatctgggtgctag

SEQ ID NO: 47626 - DNA, 25 bp, Homo sapiens
taatccttgctatctgggtgctagt

SEQ ID NO: 47627 - DNA, 26 bp, Homo sapiens
taatccttgctatctgggtgctagtg

SEQ ID NO: 47628 - DNA, 27 bp, Homo sapiens
taatccttgctatctgggtgctagtgc

SEQ ID NO: 47629 - DNA, 18 bp, Homo sapiens
aatccttgctatctgggt

SEQ ID NO: 47630 - DNA, 21 bp, Homo sapiens
aatccttgctatctgggtgct

SEQ ID NO: 47631 - DNA, 22 bp, Homo sapiens
aatccttgctatctgggtgcta

SEQ ID NO: 47632 - DNA, 23 bp, Homo sapiens
aatccttgctatctgggtgctag

SEQ ID NO: 47633 - DNA, 24 bp, Homo sapiens
aatccttgctatctgggtgctagt

SEQ ID NO: 47634 - DNA, 25 bp, Homo sapiens
aatccttgctatctgggtgctagtg

SEQ ID NO: 47635 - DNA, 26 bp, Homo sapiens
aatccttgctatctgggtgctagtgc

SEQ ID NO: 47636 - DNA, 28 bp, Homo sapiens
aatccttgctatctgggtgctagtgctg

SEQ ID NO: 47637 - DNA, 23 bp, Homo sapiens
aatgcacctgggcaaggattcag

SEQ ID NO: 47638 - DNA, 24 bp, Homo sapiens
aatgcacctgggcaaggattcaga

SEQ ID NO: 47639 - DNA, 25 bp, Homo sapiens
aatgcacctgggcaaggattcagag

SEQ ID NO: 47640 - DNA, 27 bp, Homo sapiens
aatgcacctgggcaaggattcagagag

SEQ ID NO: 47641 - DNA, 21 bp, Homo sapiens
atgcacctgggcaaggattca

SEQ ID NO: 47642 - DNA, 26 bp, Homo sapiens
tgtctctcgcccttggccttagaatg

SEQ ID NO: 47643 - DNA, 24 bp, Homo sapiens
tgtctctcgcccttggccttagaa

SEQ ID NO: 47644 - DNA, 22 bp, Homo sapiens
gtctctcgcccttggccttaga

SEQ ID NO: 47645 - DNA, 23 bp, Homo sapiens
tgtctctcgcccttggccttaga

SEQ ID NO: 47646 - DNA, 24 bp, Homo sapiens
ctgtctctcgcccttggccttaga

SEQ ID NO: 47647 - DNA, 16 bp, Homo sapiens
tgtctctcgcccttgg

SEQ ID NO: 47648 - DNA, 25 bp, Homo sapiens
agggccaggcacagagtaagcatca

SEQ ID NO: 47649 - DNA, 23 bp, Homo sapiens
gggccaggcacagagtaagcatc

SEQ ID NO: 47650 - DNA, 24 bp, Homo sapiens
agggccaggcacagagtaagcatc

SEQ ID NO: 47651 - DNA, 25 bp, Homo sapiens
cagggccaggcacagagtaagcatc

SEQ ID NO: 47652 - DNA, 26 bp, Homo sapiens
tcagggccaggcacagagtaagcatc

SEQ ID NO: 47653 - DNA, 23 bp, Homo sapiens
agggccaggcacagagtaagcat

SEQ ID NO: 47654 - DNA, 24 bp, Homo sapiens
cagggccaggcacagagtaagcat

SEQ ID NO: 47655 - DNA, 23 bp, Homo sapiens
cagggccaggcacagagtaagca

SEQ ID NO: 47656 - DNA, 22 bp, Homo sapiens
cagggccaggcacagagtaagc

SEQ ID NO: 47657 - DNA, 23 bp, Homo sapiens
tcagggccaggcacagagtaagc

SEQ ID NO: 47658 - DNA, 20 bp, Homo sapiens
agggccaggcacagagtaag

SEQ ID NO: 47659 - DNA, 22 bp, Homo sapiens
tcagggccaggcacagagtaag

SEQ ID NO: 47660 - DNA, 26 bp, Homo sapiens
cagctcagggccaggcacagagtaag

SEQ ID NO: 47661 - DNA, 20 bp, Homo sapiens
cagggccaggcacagagtaa

SEQ ID NO: 47662 - DNA, 21 bp, Homo sapiens
tcagggccaggcacagagtaa

SEQ ID NO: 47663 - DNA, 25 bp, Homo sapiens
tgcctgccctcttcctccaggtatc

SEQ ID NO: 47664 - DNA, 26 bp, Homo sapiens
ttgcctgccctcttcctccaggtatc

SEQ ID NO: 47665 - DNA, 24 bp, Homo sapiens
tgcctgccctcttcctccaggtat

SEQ ID NO: 47666 - DNA, 23 bp, Homo sapiens
tgcctgccctcttcctccaggta

SEQ ID NO: 47667 - DNA, 24 bp, Homo sapiens
ttgcctgccctcttcctccaggta

SEQ ID NO: 47668 - DNA, 22 bp, Homo sapiens
tgcctgccctcttcctccaggt

SEQ ID NO: 47669 - DNA, 23 bp, Homo sapiens
ttgcctgccctcttcctccaggt

SEQ ID NO: 47670 - DNA, 21 bp, Homo sapiens
tgcctgccctcttcctccagg

SEQ ID NO: 47671 - DNA, 22 bp, Homo sapiens
ttgcctgccctcttcctccagg

SEQ ID NO: 47672 - DNA, 20 bp, Homo sapiens
tgcctgccctcttcctccag

SEQ ID NO: 47673 - DNA, 19 bp, Homo sapiens
tgcctgccctcttcctcca

SEQ ID NO: 47674 - DNA, 20 bp, Homo sapiens
ttgcctgccctcttcctcca

SEQ ID NO: 47675 - DNA, 25 bp, Homo sapiens
ggaggatggagagctgggccagaca

SEQ ID NO: 47676 - DNA, 27 bp, Homo sapiens
aaggaggatggagagctgggccagaca

SEQ ID NO: 47677 - DNA, 25 bp, Homo sapiens
aggaggatggagagctgggccagac

SEQ ID NO: 47678 - DNA, 26 bp, Homo sapiens
aaggaggatggagagctgggccagac

SEQ ID NO: 47679 - DNA, 25 bp, Homo sapiens
aaggaggatggagagctgggccaga

SEQ ID NO: 47680 - DNA, 24 bp, Homo sapiens
aaggaggatggagagctgggccag

SEQ ID NO: 47681 - DNA, 23 bp, Homo sapiens
aaggaggatggagagctgggcca

SEQ ID NO: 47682 - DNA, 22 bp, Homo sapiens
aaggaggatggagagctgggcc

SEQ ID NO: 47683 - DNA, 21 bp, Homo sapiens
aaggaggatggagagctgggc

SEQ ID NO: 47684 - DNA, 20 bp, Homo sapiens
aaggaggatggagagctggg

SEQ ID NO: 47685 - DNA, 23 bp, Homo sapiens
tgactgagcttctccccacaggt

SEQ ID NO: 47686 - DNA, 22 bp, Homo sapiens
tgactgagcttctccccacagg

SEQ ID NO: 47687 - DNA, 23 bp, Homo sapiens
ctgactgagcttctccccacagg

SEQ ID NO: 47688 - DNA, 20 bp, Homo sapiens
tgactgagcttctccccaca

SEQ ID NO: 47689 - DNA, 19 bp, Homo sapiens
tgactgagcttctccccac

SEQ ID NO: 47690 - DNA, 24 bp, Homo sapiens
ttggggattgggtcaggccagtgt

SEQ ID NO: 47691 - DNA, 23 bp, Homo sapiens
ttggggattgggtcaggccagtg

SEQ ID NO: 47692 - DNA, 24 bp, Homo sapiens
tgttggggattgggtcaggccagt

SEQ ID NO: 47693 - DNA, 26 bp, Homo sapiens
ctatacaacttactactttccctggt

SEQ ID NO: 47694 - DNA, 22 bp, Homo sapiens
tatacaacttactactttccct

SEQ ID NO: 47695 - DNA, 23 bp, Homo sapiens
ctatacaacttactactttccct

SEQ ID NO: 47696 - DNA, 21 bp, Homo sapiens
tatacaacttactactttccc

SEQ ID NO: 47697 - DNA, 21 bp, Homo sapiens
ctatacaacttactactttcc

SEQ ID NO: 47698 - DNA, 27 bp, Homo sapiens
agataactatacaacttactactttcc

SEQ ID NO: 47699 - DNA, 20 bp, Homo sapiens
ctatacaacttactactttc

SEQ ID NO: 47700 - DNA, 24 bp, Homo sapiens
tgaggtagtaagttgtattgttgt

SEQ ID NO: 47701 - DNA, 23 bp, Homo sapiens
tgaggtagtaagttgtattgttg

SEQ ID NO: 47702 - DNA, 19 bp, Homo sapiens
ggtagtaagttgtattgtt

SEQ ID NO: 47703 - DNA, 21 bp, Homo sapiens
tgaggtagtaagttgtattgt

SEQ ID NO: 47704 - DNA, 20 bp, Homo sapiens
tgaggtagtaagttgtattg

SEQ ID NO: 47705 - DNA, 19 bp, Homo sapiens
tgaggtagtaagttgtatt

SEQ ID NO: 47706 - DNA, 16 bp, Homo sapiens
tgaggtagtaagttgt

SEQ ID NO: 47707 - DNA, 25 bp, Homo sapiens
ctatacagtctactgtctttcccac

SEQ ID NO: 47708 - DNA, 23 bp, Homo sapiens
ctatacagtctactgtctttccc

SEQ ID NO: 47709 - DNA, 26 bp, Homo sapiens
ataactatacagtctactgtctttcc

SEQ ID NO: 47710 - DNA, 21 bp, Homo sapiens
ctatacagtctactgtctttc

SEQ ID NO: 47711 - DNA, 23 bp, Homo sapiens
aactatacagtctactgtctttc

SEQ ID NO: 47712 - DNA, 26 bp, Homo sapiens
gataactatacagtctactgtctttc

SEQ ID NO: 47713 - DNA, 20 bp, Homo sapiens
ctatacagtctactgtcttt

SEQ ID NO: 47714 - DNA, 19 bp, Homo sapiens
ctatacagtctactgtctt

SEQ ID NO: 47715 - DNA, 18 bp, Homo sapiens
ctatacagtctactgtct

SEQ ID NO: 47716 - DNA, 17 bp, Homo sapiens
ctatacagtctactgtc

SEQ ID NO: 47717 - DNA, 28 bp, Homo sapiens
tgaggtagtagattgtatagttttaggg

SEQ ID NO: 47718 - DNA, 27 bp, Homo sapiens
tgaggtagtagattgtatagttttagg

SEQ ID NO: 47719 - DNA, 26 bp, Homo sapiens
tgaggtagtagattgtatagttttag

SEQ ID NO: 47720 - DNA, 25 bp, Homo sapiens
tgaggtagtagattgtatagtttta

SEQ ID NO: 47721 - DNA, 24 bp, Homo sapiens
tgaggtagtagattgtatagtttt

SEQ ID NO: 47722 - DNA, 22 bp, Homo sapiens
gaggtagtagattgtatagttt

SEQ ID NO: 47723 - DNA, 23 bp, Homo sapiens
tgaggtagtagattgtatagttt

SEQ ID NO: 47724 - DNA, 23 bp, Homo sapiens
atgaggtagtagattgtatagtt

SEQ ID NO: 47725 - DNA, 22 bp, Homo sapiens
atgaggtagtagattgtatagt

SEQ ID NO: 47726 - DNA, 23 bp, Homo sapiens
gtgcatatatctaccacattatg

SEQ ID NO: 47727 - DNA, 25 bp, Homo sapiens
tcgtgcatatatctaccacattatg

SEQ ID NO: 47728 - DNA, 21 bp, Homo sapiens
tgcatatatctaccacattat

SEQ ID NO: 47729 - DNA, 24 bp, Homo sapiens
tcgtgcatatatctaccacattat

SEQ ID NO: 47730 - DNA, 21 bp, Homo sapiens
gtgcatatatctaccacatta

SEQ ID NO: 47731 - DNA, 22 bp, Homo sapiens
cgtgcatatatctaccacatta

SEQ ID NO: 47732 - DNA, 23 bp, Homo sapiens
tcgtgcatatatctaccacatta

SEQ ID NO: 47733 - DNA, 22 bp, Homo sapiens
tcgtgcatatatctaccacatt

SEQ ID NO: 47734 - DNA, 23 bp, Homo sapiens
tggtagatatatgcacgatatag

SEQ ID NO: 47735 - DNA, 24 bp, Homo sapiens
cctatatcgtgcatatatctacca

SEQ ID NO: 47736 - DNA, 23 bp, Homo sapiens
cctatatcgtgcatatatctacc

SEQ ID NO: 47737 - DNA, 16 bp, Homo sapiens
tatatatcgtgcatat

SEQ ID NO: 47738 - DNA, 20 bp, Homo sapiens
agatatatgcacgatatata

SEQ ID NO: 47739 - DNA, 24 bp, Homo sapiens
tggtagatatatgcacgatatata

SEQ ID NO: 47740 - DNA, 22 bp, Homo sapiens
tgtggtagatatatgcacgata

SEQ ID NO: 47741 - DNA, 22 bp, Homo sapiens
atcgtgcatatatctaccacat

SEQ ID NO: 47742 - DNA, 21 bp, Homo sapiens
atgtggtagatatatgcacga

SEQ ID NO: 47743 - DNA, 22 bp, Homo sapiens
tcgtgcatatatctaccacatt

SEQ ID NO: 47744 - DNA, 23 bp, Homo sapiens
aaatgtggtagatatatgcacga

SEQ ID NO: 47745 - DNA, 23 bp, Homo sapiens
tcgtgcatatatctaccacattt

SEQ ID NO: 47746 - DNA, 26 bp, Homo sapiens
tcgtgcatatatctaccacattttaa

SEQ ID NO: 47747 - DNA, 27 bp, Homo sapiens
tcgtgcatatatctaccacattttaaa

SEQ ID NO: 47748 - DNA, 22 bp, Homo sapiens
cgtgcatatatctaccacattt

SEQ ID NO: 47749 - DNA, 21 bp, Homo sapiens
agcaaaataagcaaatggaaa

SEQ ID NO: 47750 - DNA, 20 bp, Homo sapiens
agcaaaataagcaaatggaa

SEQ ID NO: 47751 - DNA, 22 bp, Homo sapiens
tcagcaaaataagcaaatggaa

SEQ ID NO: 47752 - DNA, 21 bp, Homo sapiens
tcagcaaaataagcaaatgga

SEQ ID NO: 47753 - DNA, 20 bp, Homo sapiens
tcagcaaaataagcaaatgg

SEQ ID NO: 47754 - DNA, 27 bp, Homo sapiens
ctccgtttgcctgtttcgctgatgtgc

SEQ ID NO: 47755 - DNA, 25 bp, Homo sapiens
ctccgtttgcctgtttcgctgatgt

SEQ ID NO: 47756 - DNA, 24 bp, Homo sapiens
ctccgtttgcctgtttcgctgatg

SEQ ID NO: 47757 - DNA, 22 bp, Homo sapiens
tccgtttgcctgtttcgctgat

SEQ ID NO: 47758 - DNA, 23 bp, Homo sapiens
ctccgtttgcctgtttcgctgat

SEQ ID NO: 47759 - DNA, 22 bp, Homo sapiens
ctccgtttgcctgtttcgctga

SEQ ID NO: 47760 - DNA, 20 bp, Homo sapiens
ctccgtttgcctgtttcgct

SEQ ID NO: 47761 - DNA, 19 bp, Homo sapiens
ctccgtttgcctgtttcgc

SEQ ID NO: 47762 - DNA, 18 bp, Homo sapiens
ctccgtttgcctgtttcg

SEQ ID NO: 47763 - DNA, 17 bp, Homo sapiens
ctccgtttgcctgtttc

SEQ ID NO: 47764 - DNA, 16 bp, Homo sapiens
cgtgtatttgacaagc

SEQ ID NO: 47765 - DNA, 18 bp, Homo sapiens
cgtgtatttgacaagctg

SEQ ID NO: 47766 - DNA, 19 bp, Homo sapiens
cgtgtatttgacaagctga

SEQ ID NO: 47767 - DNA, 20 bp, Homo sapiens
cgtgtatttgacaagctgag

SEQ ID NO: 47768 - DNA, 21 bp, Homo sapiens
cgtgtatttgacaagctgagt

SEQ ID NO: 47769 - DNA, 23 bp, Homo sapiens
cgtgtatttgacaagctgagttg

SEQ ID NO: 47770 - DNA, 24 bp, Homo sapiens
cgtgtatttgacaagctgagttgg

SEQ ID NO: 47771 - DNA, 25 bp, Homo sapiens
cgtgtatttgacaagctgagttgga

SEQ ID NO: 47772 - DNA, 26 bp, Homo sapiens
cgtgtatttgacaagctgagttggac

SEQ ID NO: 47773 - DNA, 27 bp, Homo sapiens
cgtgtatttgacaagctgagttggaca

SEQ ID NO: 47774 - DNA, 28 bp, Homo sapiens
cgtgtatttgacaagctgagttggacac

SEQ ID NO: 47775 - DNA, 22 bp, Homo sapiens
tttgacaagctgagttggacac

SEQ ID NO: 47776 - DNA, 19 bp, Homo sapiens
tgtcagtttgtcaaatacc

SEQ ID NO: 47777 - DNA, 20 bp, Homo sapiens
tgtcagtttgtcaaataccc

SEQ ID NO: 47778 - DNA, 21 bp, Homo sapiens
tgtcagtttgtcaaatacccc

SEQ ID NO: 47779 - DNA, 23 bp, Homo sapiens
tgtcagtttgtcaaataccccaa

SEQ ID NO: 47780 - DNA, 24 bp, Homo sapiens
tgtcagtttgtcaaataccccaag

SEQ ID NO: 47781 - DNA, 25 bp, Homo sapiens
tgtcagtttgtcaaataccccaagt

SEQ ID NO: 47782 - DNA, 21 bp, Homo sapiens
gtcagtttgtcaaatacccca

SEQ ID NO: 47783 - DNA, 22 bp, Homo sapiens
gtcagtttgtcaaataccccaa

SEQ ID NO: 47784 - DNA, 23 bp, Homo sapiens
gactcttcaacctcaggacttgc

SEQ ID NO: 47785 - DNA, 21 bp, Homo sapiens
actcttcaacctcaggacttg

SEQ ID NO: 47786 - DNA, 22 bp, Homo sapiens
actcttcaacctcaggacttgc

SEQ ID NO: 47787 - DNA, 23 bp, Homo sapiens
actcttcaacctcaggacttgca

SEQ ID NO: 47788 - DNA, 20 bp, Homo sapiens
ctcttcaacctcaggacttg

SEQ ID NO: 47789 - DNA, 21 bp, Homo sapiens
ctcttcaacctcaggacttgc

SEQ ID NO: 47790 - DNA, 22 bp, Homo sapiens
ctcttcaacctcaggacttgca

SEQ ID NO: 47791 - DNA, 18 bp, Homo sapiens
tcttcaacctcaggactt

SEQ ID NO: 47792 - DNA, 19 bp, Homo sapiens
tcttcaacctcaggacttg

SEQ ID NO: 47793 - DNA, 20 bp, Homo sapiens
tcttcaacctcaggacttgc

SEQ ID NO: 47794 - DNA, 20 bp, Homo sapiens
cttcaacctcaggacttgca

SEQ ID NO: 47795 - DNA, 19 bp, Homo sapiens
ggaatgctgtcctaaggtt

SEQ ID NO: 47796 - DNA, 17 bp, Homo sapiens
ctgtcctaaggttgttg

SEQ ID NO: 47797 - DNA, 18 bp, Homo sapiens
ctgtcctaaggttgttga

SEQ ID NO: 47798 - DNA, 20 bp, Homo sapiens
ctgtcctaaggttgttgagt

SEQ ID NO: 47799 - DNA, 22 bp, Homo sapiens
ctgtcctaaggttgttgagttg

SEQ ID NO: 47800 - DNA, 23 bp, Homo sapiens
ctgtcctaaggttgttgagttgt

SEQ ID NO: 47801 - DNA, 24 bp, Homo sapiens
ctgtcctaaggttgttgagttgtg

SEQ ID NO: 47802 - DNA, 21 bp, Homo sapiens
tgtcctaaggttgttgagttg

SEQ ID NO: 47803 - DNA, 22 bp, Homo sapiens
gtcctaaggttgttgagttgtg

SEQ ID NO: 47804 - DNA, 18 bp, Homo sapiens
tgggcccgcgggcgctcc

SEQ ID NO: 47805 - DNA, 20 bp, Homo sapiens
ccgcgggcgctcctggccgc

SEQ ID NO: 47806 - DNA, 21 bp, Homo sapiens
ccgcgggcgctcctggccgcc

SEQ ID NO: 47807 - DNA, 22 bp, Homo sapiens
ccgcgggcgctcctggccgccg

SEQ ID NO: 47808 - DNA, 23 bp, Homo sapiens
ccgcgggcgctcctggccgccgc

SEQ ID NO: 47809 - DNA, 24 bp, Homo sapiens
ccgcgggcgctcctggccgccgcc

SEQ ID NO: 47810 - DNA, 25 bp, Homo sapiens
ccgcgggcgctcctggccgccgccc

SEQ ID NO: 47811 - DNA, 26 bp, Homo sapiens
ccgcgggcgctcctggccgccgcccg

SEQ ID NO: 47812 - DNA, 28 bp, Homo sapiens
ccgcgggcgctcctggccgccgcccgac

SEQ ID NO: 47813 - DNA, 21 bp, Homo sapiens
cgcgggcgctcctggccgccg

SEQ ID NO: 47814 - DNA, 22 bp, Homo sapiens
cgcgggcgctcctggccgccgc

SEQ ID NO: 47815 - DNA, 24 bp, Homo sapiens
cgcgggcgctcctggccgccgccc

SEQ ID NO: 47816 - DNA, 23 bp, Homo sapiens
acagacattaattgggcgcctgc

SEQ ID NO: 47817 - DNA, 23 bp, Homo sapiens
aacagacattaattgggcgcctg

SEQ ID NO: 47818 - DNA, 25 bp, Homo sapiens
atcaacagacattaattgggcgcct

SEQ ID NO: 47819 - DNA, 21 bp, Homo sapiens
aacagacattaattgggcgcc

SEQ ID NO: 47820 - DNA, 24 bp, Homo sapiens
atcaacagacattaattgggcgcc

SEQ ID NO: 47821 - DNA, 22 bp, Homo sapiens
tcaacagacattaattgggcgc

SEQ ID NO: 47822 - DNA, 22 bp, Homo sapiens
atcaacagacattaattgggcg

SEQ ID NO: 47823 - DNA, 21 bp, Homo sapiens
atcaacagacattaattgggc

SEQ ID NO: 47824 - DNA, 20 bp, Homo sapiens
atcaacagacattaattggg

SEQ ID NO: 47825 - DNA, 19 bp, Homo sapiens
atcaacagacattaattgg

SEQ ID NO: 47826 - DNA, 18 bp, Homo sapiens
atcaacagacattaattg

SEQ ID NO: 47827 - DNA, 27 bp, Homo sapiens
cttagcaggttgtattatcattgtccg

SEQ ID NO: 47828 - DNA, 24 bp, Homo sapiens
ttagcaggttgtattatcattgtc

SEQ ID NO: 47829 - DNA, 25 bp, Homo sapiens
cttagcaggttgtattatcattgtc

SEQ ID NO: 47830 - DNA, 24 bp, Homo sapiens
cttagcaggttgtattatcattgt

SEQ ID NO: 47831 - DNA, 22 bp, Homo sapiens
ttagcaggttgtattatcattg

SEQ ID NO: 47832 - DNA, 23 bp, Homo sapiens
cttagcaggttgtattatcattg

SEQ ID NO: 47833 - DNA, 21 bp, Homo sapiens
ttagcaggttgtattatcatt

SEQ ID NO: 47834 - DNA, 23 bp, Homo sapiens
acttagcaggttgtattatcatt

SEQ ID NO: 47835 - DNA, 21 bp, Homo sapiens
cttagcaggttgtattatcat

SEQ ID NO: 47836 - DNA, 22 bp, Homo sapiens
acttagcaggttgtattatcat

SEQ ID NO: 47837 - DNA, 22 bp, Homo sapiens
atgataatacaacctgctaagt

SEQ ID NO: 47838 - DNA, 23 bp, Homo sapiens
atgataatacaacctgctaagtg

SEQ ID NO: 47839 - DNA, 20 bp, Homo sapiens
cttagcaggttgtattatca

SEQ ID NO: 47840 - DNA, 20 bp, Homo sapiens
tgataatacaacctgctaag

SEQ ID NO: 47841 - DNA, 21 bp, Homo sapiens
acttagcaggttgtattatca

SEQ ID NO: 47842 - DNA, 21 bp, Homo sapiens
tgataatacaacctgctaagt

SEQ ID NO: 47843 - DNA, 22 bp, Homo sapiens
cacttagcaggttgtattatca

SEQ ID NO: 47844 - DNA, 22 bp, Homo sapiens
tgataatacaacctgctaagtg

SEQ ID NO: 47845 - DNA, 23 bp, Homo sapiens
tgataatacaacctgctaagtgc

SEQ ID NO: 47846 - DNA, 24 bp, Homo sapiens
tgataatacaacctgctaagtgct

SEQ ID NO: 47847 - DNA, 19 bp, Homo sapiens
cttagcaggttgtattatc

SEQ ID NO: 47848 - DNA, 20 bp, Homo sapiens
acttagcaggttgtattatc

SEQ ID NO: 47849 - DNA, 21 bp, Homo sapiens
ataatacaacctgctaagtgc

SEQ ID NO: 47850 - DNA, 23 bp, Homo sapiens
ataatacaacctgctaagtgcta

SEQ ID NO: 47851 - DNA, 24 bp, Homo sapiens
ataatacaacctgctaagtgctag

SEQ ID NO: 47852 - DNA, 20 bp, Homo sapiens
taatacaacctgctaagtgc

SEQ ID NO: 47853 - DNA, 21 bp, Homo sapiens
taatacaacctgctaagtgct

SEQ ID NO: 47854 - DNA, 22 bp, Homo sapiens
taatacaacctgctaagtgcta

SEQ ID NO: 47855 - DNA, 23 bp, Homo sapiens
taatacaacctgctaagtgctag

SEQ ID NO: 47856 - DNA, 27 bp, Homo sapiens
atataatacaacctgctaagtgtccta

SEQ ID NO: 47857 - DNA, 24 bp, Homo sapiens
atataatacaacctgctaagtgtc

SEQ ID NO: 47858 - DNA, 23 bp, Homo sapiens
atataatacaacctgctaagtgt

SEQ ID NO: 47859 - DNA, 21 bp, Homo sapiens
cacttagcaggttgtattata

SEQ ID NO: 47860 - DNA, 21 bp, Homo sapiens
atataatacaacctgctaagt

SEQ ID NO: 47861 - DNA, 22 bp, Homo sapiens
acttagcaggttgtattatatc

SEQ ID NO: 47862 - DNA, 19 bp, Homo sapiens
cttagcaggttgtattata

SEQ ID NO: 47863 - DNA, 20 bp, Homo sapiens
atataatacaacctgctaag

SEQ ID NO: 47864 - DNA, 20 bp, Homo sapiens
cttagcaggttgtattatat

SEQ ID NO: 47865 - DNA, 21 bp, Homo sapiens
cttagcaggttgtattatatc

SEQ ID NO: 47866 - DNA, 22 bp, Homo sapiens
cttagcaggttgtattatatcc

SEQ ID NO: 47867 - DNA, 23 bp, Homo sapiens
cttagcaggttgtattatatcca

SEQ ID NO: 47868 - DNA, 19 bp, Homo sapiens
atataatacaacctgctaa

SEQ ID NO: 47869 - DNA, 18 bp, Homo sapiens
atataatacaacctgcta

SEQ ID NO: 47870 - DNA, 28 bp, Homo sapiens
tcagcaaacatttattgtgtgcctgcta

SEQ ID NO: 47871 - DNA, 25 bp, Homo sapiens
atcagcaaacatttattgtgtgcct

SEQ ID NO: 47872 - DNA, 24 bp, Homo sapiens
atcagcaaacatttattgtgtgcc

SEQ ID NO: 47873 - DNA, 23 bp, Homo sapiens
atcagcaaacatttattgtgtgc

SEQ ID NO: 47874 - DNA, 22 bp, Homo sapiens
atcagcaaacatttattgtgtg

SEQ ID NO: 47875 - DNA, 21 bp, Homo sapiens
atcagcaaacatttattgtgt

SEQ ID NO: 47876 - DNA, 20 bp, Homo sapiens
atcagcaaacatttattgtg

SEQ ID NO: 47877 - DNA, 20 bp, Homo sapiens
gactcatcagcaaacattta

SEQ ID NO: 47878 - DNA, 23 bp, Homo sapiens
agtaaatgtttattagatgaata

SEQ ID NO: 47879 - DNA, 24 bp, Homo sapiens
cagtaaatgtttattagatgaata

SEQ ID NO: 47880 - DNA, 25 bp, Homo sapiens
tcagtaaatgtttattagatgaata

SEQ ID NO: 47881 - DNA, 27 bp, Homo sapiens
cctcagtaaatgtttattagatgaata

SEQ ID NO: 47882 - DNA, 23 bp, Homo sapiens
tcagtaaatgtttattagatgaa

SEQ ID NO: 47883 - DNA, 20 bp, Homo sapiens
agtaaatgtttattagatga

SEQ ID NO: 47884 - DNA, 23 bp, Homo sapiens
ctcagtaaatgtttattagatga

SEQ ID NO: 47885 - DNA, 23 bp, Homo sapiens
cctcagtaaatgtttattagatg

SEQ ID NO: 47886 - DNA, 22 bp, Homo sapiens
cctcagtaaatgtttattagat

SEQ ID NO: 47887 - DNA, 21 bp, Homo sapiens
cctcagtaaatgtttattaga

SEQ ID NO: 47888 - DNA, 26 bp, Homo sapiens
cttatcagattgtattgtaattgtct

SEQ ID NO: 47889 - DNA, 24 bp, Homo sapiens
ttatcagattgtattgtaattgtc

SEQ ID NO: 47890 - DNA, 25 bp, Homo sapiens
cttatcagattgtattgtaattgtc

SEQ ID NO: 47891 - DNA, 24 bp, Homo sapiens
cttatcagattgtattgtaattgt

SEQ ID NO: 47892 - DNA, 22 bp, Homo sapiens
ttatcagattgtattgtaattg

SEQ ID NO: 47893 - DNA, 23 bp, Homo sapiens
cttatcagattgtattgtaattg

SEQ ID NO: 47894 - DNA, 28 bp, Homo sapiens
atagcacttatcagattgtattgtaatt

SEQ ID NO: 47895 - DNA, 21 bp, Homo sapiens
cttatcagattgtattgtaat

SEQ ID NO: 47896 - DNA, 20 bp, Homo sapiens
cttatcagattgtattgtaa

SEQ ID NO: 47897 - DNA, 21 bp, Homo sapiens
acttatcagattgtattgtaa

SEQ ID NO: 47898 - DNA, 19 bp, Homo sapiens
cttatcagattgtattgta

SEQ ID NO: 47899 - DNA, 23 bp, Homo sapiens
tagcacttatcagattgtattgt

SEQ ID NO: 47900 - DNA, 27 bp, Homo sapiens
ttataatacaacctgataagtgttata

SEQ ID NO: 47901 - DNA, 22 bp, Homo sapiens
aatacaacctgataagtgttat

SEQ ID NO: 47902 - DNA, 24 bp, Homo sapiens
ttataatacaacctgataagtgtt

SEQ ID NO: 47903 - DNA, 22 bp, Homo sapiens
tataatacaacctgataagtgt

SEQ ID NO: 47904 - DNA, 23 bp, Homo sapiens
ttataatacaacctgataagtgt

SEQ ID NO: 47905 - DNA, 21 bp, Homo sapiens
tataatacaacctgataagtg

SEQ ID NO: 47906 - DNA, 21 bp, Homo sapiens
ttataatacaacctgataagt

SEQ ID NO: 47907 - DNA, 20 bp, Homo sapiens
ttataatacaacctgataag

SEQ ID NO: 47908 - DNA, 19 bp, Homo sapiens
ttataatacaacctgataa

SEQ ID NO: 47909 - DNA, 17 bp, Homo sapiens
ttataatacaacctgat

SEQ ID NO: 47910 - DNA, 17 bp, Homo sapiens
aattgttcataatgcct

SEQ ID NO: 47911 - DNA, 22 bp, Homo sapiens
attcctagaaattgttcataat

SEQ ID NO: 47912 - DNA, 24 bp, Homo sapiens
tcctagtaggtgtccagtaagtgt

SEQ ID NO: 47913 - DNA, 22 bp, Homo sapiens
cctagtaggtgtccagtaagtg

SEQ ID NO: 47914 - DNA, 22 bp, Homo sapiens
accagttttcccaggattaact

SEQ ID NO: 47915 - DNA, 23 bp, Homo sapiens
aaccagttttcccaggattaact

SEQ ID NO: 47916 - DNA, 22 bp, Homo sapiens
aaccagttttcccaggattaac

SEQ ID NO: 47917 - DNA, 21 bp, Homo sapiens
aaccagttttcccaggattaa

SEQ ID NO: 47918 - DNA, 19 bp, Homo sapiens
accagttttcccaggatta

SEQ ID NO: 47919 - DNA, 20 bp, Homo sapiens
aaccagttttcccaggatta

SEQ ID NO: 47920 - DNA, 19 bp, Homo sapiens
aaccagttttcccaggatt

SEQ ID NO: 47921 - DNA, 16 bp, Homo sapiens
tttaggataagcttga

SEQ ID NO: 47922 - DNA, 19 bp, Homo sapiens
tttaggataagcttgactt

SEQ ID NO: 47923 - DNA, 20 bp, Homo sapiens
tttaggataagcttgacttt

SEQ ID NO: 47924 - DNA, 21 bp, Homo sapiens
tttaggataagcttgactttt

SEQ ID NO: 47925 - DNA, 23 bp, Homo sapiens
tttaggataagcttgacttttgt

SEQ ID NO: 47926 - DNA, 24 bp, Homo sapiens
tttaggataagcttgacttttgtt

SEQ ID NO: 47927 - DNA, 25 bp, Homo sapiens
tttaggataagcttgacttttgttc

SEQ ID NO: 47928 - DNA, 21 bp, Homo sapiens
ttaggataagcttgacttttg

SEQ ID NO: 47929 - DNA, 22 bp, Homo sapiens
ttaggataagcttgacttttgt

SEQ ID NO: 47930 - DNA, 24 bp, Homo sapiens
ttaggataagcttgacttttgttc

SEQ ID NO: 47931 - DNA, 19 bp, Homo sapiens
aaaggaaagtgtatcctaa

SEQ ID NO: 47932 - DNA, 20 bp, Homo sapiens
aaaggaaagtgtatcctaaa

SEQ ID NO: 47933 - DNA, 23 bp, Homo sapiens
aaaggaaagtgtatcctaaaagg

SEQ ID NO: 47934 - DNA, 24 bp, Homo sapiens
aaaggaaagtgtatcctaaaaggc

SEQ ID NO: 47935 - DNA, 18 bp, Homo sapiens
aaggaaagtgtatcctaa

SEQ ID NO: 47936 - DNA, 21 bp, Homo sapiens
aaggaaagtgtatcctaaaag

SEQ ID NO: 47937 - DNA, 22 bp, Homo sapiens
aaggaaagtgtatcctaaaagg

SEQ ID NO: 47938 - DNA, 23 bp, Homo sapiens
aaggaaagtgtatcctaaaaggc

SEQ ID NO: 47939 - DNA, 27 bp, Homo sapiens
cccccaggtgtgattctgatttgcttc

SEQ ID NO: 47940 - DNA, 28 bp, Homo sapiens
tcccccaggtgtgattctgatttgcttc

SEQ ID NO: 47941 - DNA, 26 bp, Homo sapiens
tcccccaggtgtgattctgatttgct

SEQ ID NO: 47942 - DNA, 24 bp, Homo sapiens
cccccaggtgtgattctgatttgc

SEQ ID NO: 47943 - DNA, 25 bp, Homo sapiens
tcccccaggtgtgattctgatttgc

SEQ ID NO: 47944 - DNA, 23 bp, Homo sapiens
cccccaggtgtgattctgatttg

SEQ ID NO: 47945 - DNA, 24 bp, Homo sapiens
tcccccaggtgtgattctgatttg

SEQ ID NO: 47946 - DNA, 22 bp, Homo sapiens
tcccccaggtgtgattctgatt

SEQ ID NO: 47947 - DNA, 21 bp, Homo sapiens
tcccccaggtgtgattctgat

SEQ ID NO: 47948 - DNA, 20 bp, Homo sapiens
tcccccaggtgtgattctga

SEQ ID NO: 47949 - DNA, 25 bp, Homo sapiens
ttatcagaatctccaggggtacttt

SEQ ID NO: 47950 - DNA, 24 bp, Homo sapiens
ttatcagaatctccaggggtactt

SEQ ID NO: 47951 - DNA, 23 bp, Homo sapiens
ttatcagaatctccaggggtact

SEQ ID NO: 47952 - DNA, 21 bp, Homo sapiens
ttatcagaatctccaggggta

SEQ ID NO: 47953 - DNA, 20 bp, Homo sapiens
ttatcagaatctccaggggt

SEQ ID NO: 47954 - DNA, 19 bp, Homo sapiens
ttatcagaatctccagggg

SEQ ID NO: 47955 - DNA, 25 bp, Homo sapiens
tgagaactgaattccataggctgtg

SEQ ID NO: 47956 - DNA, 16 bp, Homo sapiens
cggacctcgaccggct

SEQ ID NO: 47957 - DNA, 24 bp, Homo sapiens
accgatttctcctggtgttcagag

SEQ ID NO: 47958 - DNA, 19 bp, Homo sapiens
acatccttgactggaagct

SEQ ID NO: 47959 - DNA, 16 bp, Homo sapiens
agctcggtctgaggcc

SEQ ID NO: 47960 - DNA, 20 bp, Homo sapiens
acttggatctgaaggctgcc

SEQ ID NO: 47961 - DNA, 18 bp, Homo sapiens
cataaagtagaaagcact

SEQ ID NO: 47962 - DNA, 19 bp, Homo sapiens
tagcttatcagactgatgt

SEQ ID NO: 47963 - DNA, 18 bp, Homo sapiens
caacaccagtcgatgggc

SEQ ID NO: 47964 - DNA, 19 bp, Homo sapiens
acaccagtcgatgggctgt

SEQ ID NO: 47965 - DNA, 26 bp, Homo sapiens
ttaatgctaatcgtgataggggtttt

SEQ ID NO: 47966 - DNA, 27 bp, Homo sapiens
ttaatgctaatcgtgataggggttttt

SEQ ID NO: 47967 - DNA, 20 bp, Homo sapiens
agcgcctcgacgacagagcc

SEQ ID NO: 47968 - DNA, 22 bp, Homo sapiens
ctactgctgagctagcacttcc

SEQ ID NO: 47969 - DNA, 19 bp, Homo sapiens
ctactgctgagctagcact

SEQ ID NO: 47970 - DNA, 18 bp, Homo sapiens
taccgcactgtgggtact

SEQ ID NO: 47971 - DNA, 18 bp, Homo sapiens
ctatacgacctgctgcct

SEQ ID NO: 47972 - DNA, 19 bp, Homo sapiens
tcccccaggtgtgattctg
